United States Patent 11,549,145 (METHODS AND COMPOSITIONS FOR INHIBITING AND TREATING NEUROLOGICAL CONDITIONS) - sequence listing, part 82

SEQ ID NO: 1718 - DNA, 1442774 bp, Homo sapiens
ttttcttggtctattcttcgtattccttctcgaacatattatattctttgccccgctacccaccccagtcctccaggtagttagattcctagataaattcactcacagatcatgggaaggtaaaagagaataacacattagaaattttaaaagttgctctttttcatttatattcccagtttttctatatatatattaagagctgaccaaataatcaacagtgtccaaatttttctgccctacccagtctaacatttgtgtaacatgccctccagtttaaaatttagcaaactgcaacttcatccatgcatatattagaaattacctcttgcttttttcacaaaatattgtctcagtataattaaatgttttgttaaagtgacctattcaaaataaattatcaaagaatagcaaaagatctcaacagattaccatatactatgatgatttaacttttgctaaaagaagtaaatctaattgcttataatattaactcaaagagaaacagtacaaaatccccaaatctgtcatgtaagctaaaactcaagtgtaaattgtaatgagcagtgaacatcaccatatattgaccaccaatattaatttacaggagccttgattaactacatttatgatataatgtagttatatcataactacatactatactgtatatataactacatactatatatatactgtatatataactacatactgtatatataactacatactataatgtagttataactacattatatctaattatatatataattatatataactacattatataatatatataatatatataactacattatatatatataatatataatataaccatcaaacccgagtcatgtttgtttagaatgctgaaggttgaatggcaatgtgtactgctaaatgttaaattattacagaatatgcattattgaagtaaatcactttcctcatatcctttggaagagactggccataaaatgtagttggcctacttcagggcagtttacccatccatgaatcctgagggtgcattaagctacatcataacagtctgtgctgatacaaccaacgttctcatgttccatttactcagtcaacaggcccaatcagaatagcttaacgtaatggtgacggtaattgtcactatggagcaaatttggatttctttattcaatactatatacagaaacaaggagcacagaaggtgagggatggggtggggtagggtgggggaagattcaggaaacccataaattcatcaaaggcttggaaaataaagacttaaaaagaaatgggccgggcatggtggctcacgcctgtaatcccagcactttgggaggctgaggcaggtggatcacgaggtcaggagttcaagatcaacctggccaagatggtgaaaccctgtctctactaaaaatacaaaaaattagccaggcgtggtggtgggcgcctgtaatcccagctactcaggaggctgaggcagagaatggcgtgaacctggaaggaggtggaggttgctatgagctgagatcatgtcactgcactccagcctgggtcacagagtgaaacttcatctcaaaaaataaaaattaaaaaaatgttattcagtctgtagaaaaggatcctaagagcatttttaacagttgcaaatttcagcgtaaactcctttggaaccacaaaaacttgaacttaaattctggcacctctgcttaccagctctatgggttggggaaaattacataaacatgctaagcctcgatttcctcaactgtaatatagaatacgtatctcattgaagaatgaaatgaaataatatagacatagcagtattatctgtgcccccattattccagctcagagagctcctgtcagcatcctcctgtatgtctgaggtcctatcttaccatcctggggctttgtggtgattagctgcatagcacagctaagtggtaaacaatgaagactagtcacactcaccaggcattgctcccttttcaagagacttagctgtgaagggttcttagactagggaaatgcaaatttaaaccacaatgagataccactctacccctactagattgatgaaaatttaaaaaatttaaaaagtctcaacaatatcaaatgataccaagaatgcaaaggaactagaattctcgcacactgctggtaggagtacagaatggtattgtttttggaaaacagtttgacagttacttttggaattaaatctacctttattaaatgatgcacaagttctgctcatgggtatttacctaggattaattaaaacatatgccaacaaaagacctgtatgctaatgttacggcagctatattcataatagcccaaactgaaaagtagccaaacatccatcaaatggagaaatgataaaaatcttgtggtgtgttcatacaatctaatactactcaaaaacaaacaaacaaacaaacaaacaaacaaaactcactcttgtaaaaaataacatgtttgaaagcattatggtaaatgaaggaagccagaatgaaaaagctacatactacacgttccatttatatagagttcagaaaaatacaaagtcttagggacagaaatcaggcaaacattgctacagtctgggggactgaaaagggattgattccattggggcacaaggaatattttaggggcaatgggaatgttctatatcatagttgtggtagtcgtggtggttatatgaatatatatttatttctaaaaatgcaccaaattatacatttaaagttgtgtaattttgtcttatatagcttaggtctctataaacctgacttaaaaaatatttcataccaaaaaaaggcaagtaaaaaaagcacaagacagaaattaataagttatatatctaaacctaaacttttaccaccctgagcaatgtggcaaaaccccatttctagtaaaaaaaaaaaaaaaaaaaaaaaaaaaaaaacctatgctggatatggtggcacagcacctgtagtcccagctacttgggaggttaatgtgggagaatcacgtgagtttgggaggttgaagctgcagtgagccataaccacaccactgcactccagcctggacaaccagagtgagaacttgtctcaaataataaaataaaatgaatctaaactttgcaaaagacatacctaaaacatagttatataggaacttgaaatgtaaaaggattttaaaaaaagatattttatacaaataccaaaaaggcacaaatttaaaaagaaaatttaaaaatgaaaatacagaccaatgtagccaataactgattcttagaaaagaataataaaactcataaacttttcacaggattgatcaaggaaaagtgaaagaaagcacgaataatcagcgtcagaaataaacaagtggacatcactacatatcctgcaatcaatatcaaaagaagatattataaagagctgtaggctaatagattcaaacctgtagatggaattgtcaagatctttgaaaagcagcctttaacaaaactgaccaaagaagaaatctaatatttctttttctttttctttttttttcttttttttttttgagatggaatctcgcactgtcacccaggctggagtgcagtggcgcgatcttggctcactgcaacctctgcctcacgggttcaagcgattctcctgcctcagcctcctgagtagctgggattacaggtgcacaccaccacacccagctacttttgtattttgacggggtttcaccttgttggtcaggctggcctggaatccctgacaagtgatccactcgcttcagcctcccaaagtgctgggattacaggcgtgagccacctcacccggctgtaatatttctttcactactaagaaatggagtctaaaaatcttcctatgatttaaaaatttttaattaaattatcttgtaccagataacttgaaatacataggaagaaataacaccaatattgcacaaaatgttccagagaatggaaaaagaggtgtgtttggaagcttctgaagtgactctcaatgatcctcacctcctggtattcatgcttttgtgtaacctcctctccttgagtgtggactggacctggtgacttgcttctaatgaacaaaagacagcaaaatcatgggagatcaattccaagattaagttgcaaaagaccatgacttctgtcatgcgagcaggctttctctccttactcacttagataaagcaagctctcttgttgtaagctgccctaaggagaggctcacagggccaggatactgagagtgtccttgtgccaacaggtcatgagacactgaggtcttaatctaaaagccactgacaaactgcgtgtcactaacaaccttgtgagtgagcctgaggtggatctttctcagtggagccttgagatgactgcagacttgtgagagccaaaagatccaactaagcctttcctgacccacagaaaccatgagattataaacattgttttaaaacactaagttttgttgttgcacaggattagatgactaacacaaggaggaatgtctgcagttttattttgggagccaacataaccttattactaaaataaagtgatgtgatgatgaagaaaagtataagccaatctcactcatggacatagatgaaaaaatgctaagcaaaaaaatagccaacaaatccatttttacacaaaaaagattatgcaaaatcactaatttgggttattcctcaggaatacaagcttgtgttaacatttgaacagtaatgacatatttcattacattaagagaataaaggaagactatattatgatgatttaaacaaatgcaggaaaaatatttcataatatttaatacccattcatgaaaaaatatcctgcaaactagggacaaagtgaagtaatccttccttgagaatccttaatccaatagattattgaaaacaaaacctacatcaaaccttacttaatattgatatgttgcaagcttccctagagttcaaaatgagataaagagtcccactaataccaggtctatccaaatatacgaaaggtcctacacttttcttcacttttcttttttttttttttttttttgagatggagtcttgctctgttgcccaggctggagtgcagtggtgcaatctcagctcactgcaatctccgcctcctgggttcatgccattctcctgccccagcctccccagtagctgggactacaggcacccgccaccacacctggctaatttttttgtatttttagtagagacagggtttcactatgttagccaggatggtcttgatctcctgacatcgtggacatcatgatccgcctgcctcggcctcccaaagtgctaggattacaggtgtgagccactgcgcctggcctagacttttcaataaggaaaaataaagaaataaaacacacagttaacccttgaacaacatgggtttgaactgcatggattcgcttctaggtggattttttccagcaagcacagagggaaaatacagtacttgcagcatgcgaaactcacacatgttaaggatggacactgcagaactttaagtatttgagaattttggtcctggaaccaattcccagcctatactgagggatgactatataatgtctagtaaggaagaggaaaaaaaaggtcactcacagaaaatatgtttgcatatgtagaaaaccaaaaccatacagataaaacttgaaaatatattaagttagcaactttgataaatgcaagctcattgtacaaaatccaattgcatttccataaatcaggaaaaaaacaattttaaaaatttaaattttataaaaatactgcaactatttgaattttctaggaagcagattctgagaaagatatttccataacttactgggatgtattctcaaaaccaacatatggagagtgaagaaagtaggattgagcaaagggaaaattaaatttcaatgcagtgacaacaaggactcagccaatcaatcctacaggaggctctgaagttgggatggtgcttcaaagggtctcaaattgggataaggggacctctcaggcttttatattcttacattgaatcctctttggaaggtgggagtggtgcgaggtgaccttaggccaggtgactctcttcaactgaaggcaagctccagggagactcagctgaatgctgttaacccctaacactcccagcagctccaagaggagggtttaggtggtacaccatgacatccactacagatgacacacgcataagcatcataaatctagcaaaagtgtggaaggacttaatgcagaaaactataaaatgttattgaaagaaatcaaaacaacctcagtaaatgagaagatataccctgaacatgaacaaaaggctcaatatcataaagttgccaaatctcactaatagattgaatacaatcctaataaaaattccaatgttaagtatgtgtgtgtgtgtgtgtgtgtgtgtgtgtgtaacttgacaaaccaatactaaaaaatgtctacgaaaatgtagaaatgtaaaggctatgcctagccaagacattcttaaagaaaaaaatgagtgaaagaacttgccccactgaatattaggttttattataaaagtacaattattaagaaattaggtgctggcataagaaaagaaaaaaagctgaaagtgatataactgcctctcagttcctccatcctcctctcctatgatgactatatcttcctagctcagtcattctctcccactgtcctgcttacagtctatataccttgtcatagccagtactaagcatcacactcttggaccaccatgcctatatttcctctagtgctctcactccaacagttccttatttcaccaagatctaaaattcatgaatcaaatacatcttgtactgcccctcaccttcctgtcctcacttccctacttgcccttcttaaattcagtagcccatcattatagccctcactcacttatagcctctctcttatacttctctcccattcctctctcacttcatcacatgtaattggcaagatctcaaactccagaaaaactgataatagccataattttgcctatgccatgtctgttcccaggcacttaatgtaagctggagaaacataaaacaatgctgactcccttcactataagttatctaatagaaatggtaaaacaagacttgcaggtgacaggttaggacacagtaagcaagtaatttgcccttagtgcagaccaattatccttctatgttttactagttcgctaaattttgaagcctcttaaaaaactatctccctcctctaatctccaatatcttttcccccatcctcactcttagatgcagaatgtatttccatttcagaaaataacaaaagaatttccagtggtgcccacactgcatttattcacaaaccagcatctgcacccacatagtctgccttcccaccaattacttcagatggattgtacctgctcctgtctaaaggcaatccctcttgtgcactaaatcccattgtctctcacctacacaaacacatcagttaagttattctctcatctgtcttccattattaattttccactttgcagtgtgacattcccatcagtgtacaaacaaaaactgctataatttccaccatctgcaaaacatgaaaaaaccctctccttgacctcatatccccttccggttatcctccatgtggctgctcctttttgttgcaaagctcctttaaaattttcctatacttactacctccaacttattctcattttttcttaagctctctgtaatataataaggctttcactctccatcaccatttcacttaaaactcctcttatcaaggacaccaatgaacgcctctttgaccaaatcactggtcaactcattgagggaagttttccaagggagcatggctgagcagtccgggagttgactggtcagccatggagttgaccggtcagccatgctcccttggaaaacgtccctcatttaatttctaaataatacacggtcttgattttcctccagcttcactggccatttcctatcttctttgctgcctcatgcgcacttcccaagtctaaatagactctcttaggatgcaatctttatccatgctcactttctagattttatttagatttatccacatgattgtctaaaagactacttaaacttaacacattcaaggcagaacttccttttaacctgcccctcccactccctgccccatttcaataaggaacacttcttccatcctgccaattcctcagaccaaaaaccttggagccatttttgaatgttctctttttctcatatgccatgtccaatgaatcagcaaatcttattagatctttcttcaacatatatccagttatcaccaccccaaccactccccaccctgctcagagccatcacaatcgtttccccagattattataatgccatggactcctagccagttttctgtcccttaggcaatttattctcaactcagaaaccagagtgacccttccaaaactatgatcaagctcttatcactctctactcaagcccctcaatggctttatccctctcagggaaaaactctcatgccttaccatggcctatgaggttctatgtcatctgcatcactgtgacctctctgtcctcatctatcaccactgtcctctctctctctctcagccatatcatacttgcctcttttcttttcttttcgtttttagaagtgaagtttcactacgttgcccaggctagcctcgaactcctggactcaagcaatcctcctgcctcagcctcctgagtagcttggactacaagcatacaacatcacacccagctctgaccccttttctatccaccaagcataatattcacttgcttcttcctttacctagaaacctctttcaccagaaattacgatgtctaactctcgcacttccttcagatatttaatcagtggcttaattaatgaggaattccaggaccactctatttaaaatgacttcctcttcctttcttccacttccttggagataagagttttatagaacttatcactatatgaatatgaatatagataaaatacatagagatcattatgtctatttgtacatatatagatgtacatacatatacaatgcacatcaatacatatacataaaattttttatatttactacctatttctgcactctagaatgtaaactacgtgaatacatgatgttttgtatattttgctcattattctattcccggcatctacaactgtggctggcaaatatctggggttcaaaaattatcagttgaataagttaatatacacattcatatttttaacagatgtaaagtctttagcatttaaagactgactctgctttatctaggcattccaacaaagcctcctcctgcactttgatccctcacacttagatttaaaaagaaaacatttttatattattttctacagttggtggtttaatgaatgtcctctgtgcagttggttcattttaaagccacattatttccctgtctaatcattggcagtggcaggaagtagaattaatctaatctttcagaaggattcccctgaagcctgaagcactattgcattagacagcagaggtttttccttactaggacagattttcatgtcctagtgtatatttagacactgaatccctttaaaactaatgggaggtctgtgggccaaacacacttacaggaaatgaaaggaaatggcacagtaaaagcaagctgtgaagaaagatcttcacgcttgctgttacctaatctgtcacatgaaagatttattttaaaatttctattagataaaatgaacagaaaaataccatgtacagtattctttcagtattcctgctcttgtttccacaagtgcctcctcttcatgtgagtcatgtattgaggtaaagaaaaaagagtagaataggatattttacttatctcaaatcagaaatgtcatcctatatttgaagaataattgcaaaacaaccaaaatgaaaaaagcaatgcaattttggaaaagttgaagctataaattgtcagtaaataactaagttatttctattttcaatgaaaaataacatttggtcaaataggctgtagtttggtttattttgctgttgttattgctatgctttgttttttaagagacctaaagattagttctaatattgggtactttcttagcttcaaaatatattaatatttagttgtgcatctactactttatattgctgccatattcacgcttttattattctctattctttaacatattcttacctatataggagtttaccaaaagaagtaaacttcttcacttttttctccagcctttctgactaatactgtctgttgcaaacttcctttgcttttctaagataatattccaggcatatcccaagcctttttggtctctttcagtgacaagaacaatttcatttaagtaattgtaattcactctcagatgctaaaaaaaaaaaaaaaaatccagactaaatcagaagttcaatctaacttccattccaaatcttcactcctccgcagaactgaaacttgatctttggatgtgatagctgcaataatgaagtagtcttagtctgtttctcaccttcctttctccatctacattacctctgctacacgttctcccagggtcaagatagcaaacaggggagattaggaaaataaggatatcttatatgacagatattttataatttgccatagcacatgcccaaaggcagatgcccaaatgttagttctctcatagggcacattgtatactctttggtggttcccctttgccctctacttgtcctgccattgcaggttgttccagccagcttcatggcttgagaattctccatactaggggctgggcagggtggttcacacctgtagctcacactagcactttcagaggcagaggtggatggatcacttgagtccaggagttcaagaccagccaggccaacatggtgaatgaagcctcatctctactaaaaatacaaaaattagcctggcatggtggcatgtacctgtaatcccagctactccaggggttaagaaacaaaaaaaacacttgaacccaggagacagaggtcgcagtgagccgagattgcgccactgcactccagcctcggtggcagagcaagactctatctcaaaaaaaaaaaaaaaaaaaaaaaaaaaaaaaaaaaaaaaaaaattctccatactagaaacaggcaggaagcaggcatcagtttctttgtttatgtatgtctctgctctactgggtttatcaaggcctctgaagaattttcccaccaaaccccatctggtgagattaggcaagagttaaacatttctgtagctacataatcatccagtcagaaaacaagattccagtctcttctactttcctggcatctccagattttaaaacttaaattcttggagactcatcaaatgacttgagatgagtgctggcatctcagtctctattcccttggttggggagaatttccatggtactcctaattacaacagagacacacctattataactattctctctccaatcacactttaaagtgcctgttcttatataaaataaaagttggtagctggattaatagtttctagagagattctgctatctctcagtaatttggtcatgaatatgtttaccatctttctttataatatatgtgtacttaccacctaccattctcaggtttatgactcagttcacattctaagacattagaaaaaagttacagtctacatcctatgtcacctatcttaccattgcagaatctttgtcattctgcactatagtcaaaagcattgtgtagtagactgaaaaagagtcatcaaagacatccatagcctaatcttcagaaaccatgaatatgttaccttaaatgacaaaagggactttgcaaatgtggattgaggaccctgagatgggaagcttatcttgcattatctggtgagtcttaaatgtaatcacaaatgtcattataagagagaggcaggggtgaatattagattttagaagtaggagatgtgaaaacagaagcaagagattagaggagttcaaggaaggggccctgagccaagaaatgcaggagcccatcagaacctagaaaatgcaagaaaaggcatctcccctagagcctccagaaggagctagcctggccaacatcttgactttagcccagtgaaactgatttcagacttctggactccagaaccatgaaagaataaatttttgttcttttaacacaccaagttgtgataagttgttctagcaaccacagcaaatgaataaacattatctcatttaggatgcatttagctgaaaataataaaagtcctggactcaaatcaactgaagcaataagaaaacgtctcttttcacgtatcaagaagtgtggagttaaggctggtttaggtgtggtacaatgaagagtctagtttctttccaattctctgtgttatgcccactctgtgtgcaattttattcctgagcttgcttgtgtaaggctcatcagatgactaccagcaacagtaggacaatatattatgtcattcattgaaaaaaagaaaaactatcattttagtcatggtcctgctttttaatctcatttggccagattaggacctttactcactcctggaccaatcacaatccaagaatcctatgctctaattgacttgagcaagtgttgctgaaccaatttcaaacaagggtgaaattagcataattgtcattgcctaatcaggacccactcctgaagctgaggaatacctgggcaaaattggcaatagggagatggcaaaggataaggagaccatatatctaatttatcattcaactggaacacgactaagaatgaaagaagtcattatatgaaaaagatacttgctcacgcatgtttatagcagcacaattcacaatcgcaaaaaatgtagaaccaaccaaaatgcccatcgatcaaaaagtggataaagaaactgtggtatcaatacatacaatggaatactgctcagccataaaaaggaatgaattaatagcatttgcagcaacttagatgggattagagacgattattctaagttaagtaactcaggaatggaaaaccaaacatcgcatgttctcactcataagtgggagctaagatatgaggatgcaaaggcataagaatgacacagtggactttggggactcagggggaagagtgggagggggtaagggataaaagactacaaattaggttcagtgtatactgttgggatgatgggtgcaccacagtctcacaaatcaccactaaagaacttactcatgtaaccaaataccacctgttccccaaaatcctatgaaaataaaaaaattttaaaaataaaaattaaaaaaaaggtgccctattaagaattccaccaatataatagatataaacaggtactgtcccactcaccttgggacttatgctcatcctattggtaggaggccaatagtgtcacccacaagcattttgattagagctgactagaacactagtcaccagttcctaagaagaaaggattggctgggtgtcgtggctcacacctgtaatatcaacactctgggaggtggaggtgggcagatcatgaggtcaggagatcgagaccatcctggctaacacagtgaaaccctgtctgtactaaaaatacaaaaaattagctgggcatggtggcatgtgcctgtagtcccagctatttggtaggctgaggcaggagaattgcttgaacccaggaggcgagcttgcagtgagcagagatcatgccacttcctgccactgcactccagcctgggcgacagagtgggattccatctcaaaaaaaaaaaaaaaaaaaaaaagactgcaaaaatgaggaaacacttaatctgcaagggtagaggacttgacaaaagtcatctaattggaaagtggaaaaacaaatacctaaataaccaagcctttttaacctaattttacttttctttccatataccactcatgtaatgttaagtccaatacagaggtcaacctctaattagtttgctggggctacaataaccaagtaccatagattgggtggcttaaacaacggaactttctctcacatttccagaggctggaagtctaaaatcaaggtgttctcagtgttggttctttttgaggcctgtgagggagaatctgctccaggcctccctccttggctttagacggccatcttttctccatatctcttcacatcgtcttccctgcatgtgtctctgtctacaaatttcccctttttatgaagacaccagtcatattggattagggcctaccctgatgacctcactttaacttgattacctctgtaaaaacccttaattccaaataagtccacattatgaaatagtggggcttaggatgtcaacatctgatttggaagaggggctggggcacaattaaatccattacacaccaccaagggaaattcctaatgaggcagccagacaggggaaaggtctgtttatcaggccatatgaggaactgctaaggaagcagcaatgctgtttctcagggaaaacttgtgagagacaacttttgtctagtctcaatttcttcaaaagtcaaattagaatcaactgatataaattacatgaaaataaatttttattcacttctatatctattttcctctcttaccaagcactttctggctatgcatttgagcctttcagatgattattaaaaaaagaaggaggaagaaattattatggggtgcaaaaatactcaataaaggaaccaagctcaacattaaagacaaaaagtatcactgtcagggcttttatattcactatagtgagggtctcctccccaccaatgacttcagagaggtccctcaggcctttccctgctgtcacagtgtcctaggtgagcaatagccccgctctgtcgtttccgtgaaggttcatgaaaaaaactccaagcttaggatttcaatttgcattataaaacaatctataattaaactttgagtttcattttcaaaaactcagcaacatagccacaagagatatgcatgcatatacacacaacagacacacacacacacacacacacacacacacacacaccgttttctagccctagtgaagctgttaactgcagtaagccctcagagggccaattttaggtcaaaggaccatagcagtttgtgggaaagtgagggagaataccatttattttcgttctaaggactccatgatcaattagtgaagtccaaatgtgtctgaaaatcagactattctggtaactattttggcttctttgtgctttacagtaacaataactcgattgcctctgctgattaaatgccacacttagtccctgccacctagaaccccattgtctcattgaacaagggagttcattctgatggcagcagttactactgtcatttttggcctatagagaatagaccacggagctcttccacggtgatgctgaggggtccttcatgaaaggatttctcacaaccttggtaaagtcagtgtcctctggactgtctgaacataattaggggatgggtaagtatgtcttacatgataaattcactctagcattccaatttttctaagcctttgaatacctttctcttcagtattccacaaaagttctgatattttaacttcatttagtgtagggtgtcttggattcaggtttcagtgaaccaattataatttttaaaaaactgttaagagtcactctcagctgctcacattaacacatcgaatccaaatctgtgctcagtgcatcaacatgaatgaaatcagtcctgacataattcctgaaaatctattttgacatatattctccaaatttccatcatcattacaaattggcaaaattttgcaattcttttcatgtgtgtttaactgcttatggttcacatgctatgcctcacccctgggatcttttgaaacttaaatctgggtatagttctagaagtataacagatgtcaaggagaggtcttgaggaggatcagcaatctcccacaaggcaactaccccagggaaggctgttacaagtacttcaagaaagaggagacttggtgcgataactcagaaacagaaaatcaaataccacatgttctcacttgcaagtggaagctaaacactggatacacatggatatagagactggaataatagacactgtgagtacaaagggatggtgggggagagggctaaaaactatctattgggtacaatgttcattattcgggtgatgagtacactaaaagcccaggcttcacggctgtgcaatatatgcgtgtaagaatcctgcatttgtaccaactaaacatataaaaataattaaaaagaaaaaaaagaaaggggacgggcacggtggctcataatcctgcatttgtaccaactaaatgtataaaaataattaaaaagaaaaaaaaagaaaggggacgggcacggtggctcataatcctgcatttgtaccaactaaacgtataaaaataattaaaaagaaaaaaaaagaaaggggacgggcacggtggctcatgcctgtaatcccaacactttgggaggccgaggcgggcagattacttgaggtcaggagttcgagaccagcctggccaacatggtgaaaccccatctctacaaaaaataccaaaattagctgggtatggtggcatatgcctataatcccagctactcaggcggctgaggcaggagagtcttttgaactcaggaggcagaggttgccgtgagccgagatcgcaccactgtactccagcgtgggtgacagagcaagactccatctcaaaaaaaaaaaacaagaaagaaaagaaaagaaagaggagactaatctcttcagacaggggaagaagggctgcttctactaacaaagcagcttgatggaatatatgggttcaaggtcttcagcttcctcagaatctactgatgtctttatcccatttttcaggatcacactccttcccaaacaatgctctaacttttacataaaagagctttcaagtttaagaatttatttatttatttatgtattattttattttattttatttttttgagacagagtctcgctctgttgcccaggctggagtgcagagaggtgcaatcttggctcactgcaacccccacctcccaagttcaagtgattctcctgcctcagcctcccaagtagctgggattacaggtgtacaccaccacgtctgtctaatttttgtatttttagtagagacagggtttcacgatgttggtcaggctggtctcaaactcctgaccttgtgatccgcccacctcagcctcccaaagtgctgggaatacaggcgtgagccaccgcacccggcccaagtttaggaatttaatttgcattatagaacaacttttaattagactttgaacttgattttcagaaaacgcagtaacatagctacaagacatacacacaacagacacatacatcacacctgtatacaccaaaagtttcttttaaggaagtcatggaagtgttctggtctcttacccactttgagctgggaatttaaaagcttaagctcagaaattttctttccacaagttctccagtgcacttaaaagcaaccagtgaattccatcatattccttatttttttcctaagtggtctatactagcagctacttggtcacccaaagtgttgccttctttaggtacattaacacagttgattctacatccggtgttgggcctgaagttgtatgggtgggcctggctggcagttgggagaaaaagtgaatgttaagtgtggaagagtcgtgacaaacgggaacccacaaggacaaattgagttctgtgtctgctactgtctctaaccttgatggaattggtggtctgcaggagaagttggcatccttcatccctgggatgaacaggcacttgacccaggacttggagaagctgaaggagcagcccctgaaagccgaaaggaccacaggctctgctgatgctccaaggtggagcagcagatgccccccaaattatatgaacaacggcacctgttgtcttacataaacttttacaatgtaatagccactgctttaccaccaacttccatattgctctcaaatttctcttgtgtccaggtctaactctgaaccatacaggaagggaattctgggaaatatagtttccacttaggtaacccaatatgaagccaccatgttattcctccaatattcttttctcctccatttcttttctctgaccccgttgcccttgcatcagaatccttcctcttccttcagtgaaatgaacaaaagtctctatacattcagctcactcaaagaattatcttgggggtaagggattgtttacaggatctcacatgcctaatctctcctcaagctttaagctccctgattgtgtgtgtgtgtgcatacatgtgtctagatatacatatatatatagagtatatttgtgtataaatacaggtatagtatgtatgtgcatacatatgtgtgtatgtgtaagatcagatccttgtttattttgaaatatcatattcatattttataaataaaattttcctgtggagaaatgaataaactaatgctaaaattccaaataaacatgaaaatattaagtggtggttccattacaataatgtagacactaggatgcatttctgccagtaagaatcaattaaattaaatcagagatcaaaagatctcatattatagttctttactttcttcatttttctccactacggtataattatataaagtagaattccaagagtatgactgccaggaaaggtttattatcaaccttcgctgatgtctctttgttaaatcacttctaaagtgaagttcttattcattattgagattctattttattaaagattgattttgaaaaaggtttcagattcttataacattccatctttggtaatttcacctgcatttgacattttattaaaaagaaactaattttgcttcttgatgactcacggagttcttcatatcagacatttctttgtagaaatttgtttattttatgaactcatggccccacaccatcacccacacctgaacacacataaaaacttagtaaataaatatggtcttctgagtccttcactctccaccatactgccactgggcctatgggcaagtgtggcaaaaggtagaactctacaataattacagggcaagcgtcactccttttctgtgctcctacttgatttttctccgttttccccttctgcaacccccattgactctgacttcctaccagaaagagactatatcttctttctgtacatctttgtacttggcttaatgaggcactccccactccagagtcgtgtgatatggattcctagtgttactggcatttgaattgggagcacttaaaaaaaaattcaaaaccccaaatttctagacctgtaaatgtagctcccgggcagtgtgacaaaaaacactacaaggcccttgtacagtacagagctctgccttcccgcttactcataaagccgacccttcctattgtacttagcaggaattgtggaacacaactgcatggccagtgcccaatttccctagactgtgaaggtaaaataggacaattgtcttcataactctctctaatgaaataatccctgtccaccacagttttacatatatatatatacacacaaacatacatatataccaaaaagtttacttctatgctgttttataaagatgcgtgatttcgttcaatgcgcttaaaaatgtatatacaataacaatgcacaaccgtgaagatagataagcagaggataggtttatcctctacctttcaacatatgatgtaagatcagggcctggataaagtacccatggtaataatttgtaaaaagttctggcagcaacactagtctttgctgaaaatcgcaaaattgattcaagagagattgcaagggcaaaataaaatgtaaatttcaacccagtaaaagctgatttaacatcttttaacataaaacttgtgggacactctgcctcagcaggccataacaccagctgaacattctgcataattaaagtcgagtattcaaggtgagtgttaactactggatctgtttttaatgtaaatgaatctgggttttgttggaagcgagggccttactgaacatttatatcctctattagaaatatctatttattttaattttcactgttctttcctttttactatgttttatagaaaacattggtgtctgaagccatacaatgaagaattttcatagattatacttgcaaaagaaataccaaagtaccagaaagattctgtaagacaaacctaggatgcagacactctcttcatttcaaaaactagatatttccaggggcctgagaatctaaacactcctcaagcattcaagcagaccaaatcaagacgcttcacatctatgtcttattactattttacaaatgaatgcaacggtctcatttacagacatcctagtaaccacctcccctaccccattttttaaagattatttagctcctggttcactttctctttccccatcatgattttctatccatatctatcagtggttatcaaccttcactgcaaactgaatctcataaggagcttttaaaaagtgattataggctgggcacggtggctcacgcctgtaatcccagcactttgggaggcggaggcccccggatcacgaggtcaggagatcgacaccatcctggctaacatggtgaaaccccgtctctactaaaaatacaaaaaaattagccaggtgtggtggctggcgcctgtaatcccagctactcaggagactgaggcaggagaaaggcgtgaatccgggaggcggaggttgcagtgagccgcgatagcacccctgcactccagcctgggcgacagagcgagactccgtctcaaaaaaaaaaaaaaaagtgattataggtcccactctcagaaattctgttttaatttgtctgagatggtgactagactctggtatctttttatgaaaagctctccaggtaattttaatgagcaggcaggattgagaattgctgaggcagataattctctctacactggattccttattcctaatcttccatgctccagatatcacatactttacttacttcattcgtccactcccatggttattttaggttggtgcaaaagtaattgtggtcttttaatggcaaaaaccgcaattacttttgcaccaacctaatacaatagagcttagcattatctgcagtcctccataatgtcaattttaagcactcgacttcctttactagatctttttccaaaattcttagggcctactttggcactccattggccaccacctttaagccaaaactcccctcctcatgtcttcactgcccagaataataatcactcttctgtataaaccataactctcttctctgtctcaccttcccttgtttatgccttacaaaaccacaataatggataaatctttaagttcccgcgttgacctgtatctcgtgtggctggagaaaaacacaactatgtttgtctctctttaaatccttgaccgctaacaacaagtgagtccttagaactttctagcaatccaattttatttcccttcttaattcactctcctactgtcctagtcgattattttatacttttattctcctcacatttctaataccatttcaattttcttcattctcaagtaatggccttgcttgtcattttaataagcaattagaaaccatcaggaaatgaacttccacaatgattatatttgcctctgtatttgtgttcttcgattttttcttcttagtccttagcatctgatactgtcttttgcacataataggtgcctaaaaatcatttgagttgagctgaacctgactgaactatagtatagtctccttgaacacacacttcctgggcattgaggtgagagtagacaagaaacagagtagggagacatgggaagacagcccagggcttggagttttttaattgctgtgaacaatcaaacagtcaattaatgttaccttgagtgtttgttgaaggctgtctcaggaacatattagcaattgcagcataaacaggacacaatatcctctgctttttttttttttttttttttttttttttttttgagacagggttttgttctgttgcccaagctggagtgcaatggcacgatcttggctcactgcaacatttgtctcccgggctcaaatgattctgctgcctcagcctcctgagtagatggcactataggcacaggccactatgcccagataatacatatatatttcgtagacatggggtttcaccatttttgtccaggctggccttgaactcctaggctataatgatcctcctgcatcaaccttccaaagtgctgggattatagccatgagccattgcacccagcccatcatctgcttttgtgattgttcctagcaattaaaaattccaagtctttgatcatgtgctttacctgattccaagtttcagtagtgaaatcctctaagaattaaaacaagaagatttctgctttttgtttttgtcctgagagaatttcaccagtgaaactcagaatcagataaagcacatgaccaagagacatcattattatataagcttatacaaaactaattttgctgctgtcagcatgtgcttcagaacttcctctttcatgtgaaaacagggtgagcactccaccaaactcttaggcatctatttctgatcatcggggtcttttctcacaatgtactttctttcaatgttggtaaaatttctcaatccagtatttttcagaactctgagattaaagtagactgatatccttcacaatgtcttgttcttattttggagtagataatggtcttaaacctttctttaaaatgtgtgttgctaaaatttgaaccacttatcccaatgataatggtcaacatttatttcagagtcctaatttaatcttctcaacaaccttatgaagcagcttattattaccatcctcattaccatattataaataagaaaattgtgaatcaaagaacttatctaatgtgtctaagattacacaactgaaaactggtgaccctagaggtaaacccaggtagtttggctccagggataccacccttacccctaagtaataggtgtcccacatgtccaccccagttgtgcctatgtgagtaatgcgtgccagtggctaactaggacttgcactttcgctattttaaaagatgagagtagctatggaaagcctcttttagaaacactatgtgccactttactcaaatatctaggaaatcacttattttgtgcagatgctgaacctgcctgaacaattgctctgtctctgattcccagtaggataccaaagatgctcttgaaatagagaatcagatcccaagtgaaacagagatctagtagcccatgctgagtaagcaggatagccagtggaatgcacaaacataggagcagagatcataattcctgccttttgtgggagtccatcagacctatattgttaaatgcatgggatatctaaaaataaggaatagtaattgatgcgtccaggaagactcatctttctctcctttttaattgtgcttccaaattcatcttcctgaatattatgatattttcttcttcatttgtatttatttattgttgtttttattcctaaaggttttcaaaatggtgtcttattttggagcacccaagatgtcttctttttctcctttgatggatctctttggagaagagaccaaaaaaaaatagtttagcgctattgttggggacacacaatgcattctcatcaaaattctgaaaaatattagggcagctatgggaagttccactgtacaagctgctataataattatttttaaatatgtctcttaaaaatcacaaagaaagctttatggaagatgaatacaaaaatagcaaagaaaaaattttctagaatatttatctcaaacgaacatccccaggaggatgtagtaggaaggaagagtttaaccagaaccagtaactagaaatataaacctttttggttgtaaagaaaaccacaagatagaatttaatgcaaaatcacatgaattgaagcaggaagtttgacatgaaataatctctacctgggctgcaaacttcactttttaccttcatcttcacaggagatcaaattgacattgaaatcaaaagcagatttctctataattcaaaataatgtcagtgtatcacatttagcctaatgctataactctggtcaagaattattcagttatatacccaggaggtatacacaggagtacataaaagtattgttggttgatgcttgcctgcctgcataatccagatctcttactctaaatttctcattccaactataaaatgcaaatgttaatatggtttggtaaagataaaagtcagtataacctaaatccaaggatatcagcatctacattgtccagaaatatatccaggacatttctgaatttggctagttatgaaaaacaattagatactgctataattttcagtcagatgactttcatttctacttaaagagtgaaacatcttagaaattagaactgaagaaagtttgtactttatggtacatttgtaagacataagatgtgtaaaggatagcataaaagtattaggactttgcctctatgaaaaatagcgaattctttaatttttatatgcaatagttctgagtgttccttattgcaaaacaactttcagcaatgttgtctggattgtgaggtcctgaaaatagattccagaccaagttgatggcagtgaaagtattgagaagcaacaaattctagatatattttaaagacaaagccacagtatttcctaacagaaggaatatgagatgtaaagacaagaaaagactcaaaatcactataagatttttgtcctaagatcctagaaggatggagctgacatcaacagagatagggaaagccacaaatggaactggtttcaatgggaagagctggagttcagttttgaatatgttgactttgaaatgtttgtttgacattcaagtggagatgtggaggagacagttgaacatacaggtgtggaatttaagacgtctaggaatggaaataaaacttagaaacttgttggcatatgaacgaaggatatttaaagctatgagaatatgtgaagttaccaaggaagtgaacagagatgttgaaaagaaaagaacaaaaaactgaaccatgaaacactctaacatgaagtgctcaggaaaaccagaagcactcagcaatgagaatgagaaggcacagtatgtgagatagggaaagccaggagagtgagaactcttggaagccagctgaagaatgagtattatggagaagggagttggaggatagagaactatacattgtacctcgaaatgtggaagttattgatgacattgattaagttggaaaagcagaagaaaacgtttaacatttaaaatgctgactagttgtggtaggcagaaaaacaggctttcaaagatgtccatgttctaatccccagaacctataaatatgttatataacacagccaaggggaattaaagttgtagatggattctaatcagctaaccttaaaaggagagattatcctggattatccaagtgagccagtgtagccacgagcgtgcctaaaagtggaaaaggaaggtggaaaacgaggtcagagtgatgtagtgtgagagggatgtaacatgccattgatggttttgaatggaggaagtgggccatgagtcacagaatgtgagcagcctttggcagctggagaaggcagggagattaattcttctctagagccttttagaaaagtacacaaccctgccaacaccttgattttagcctaattaagacccttatcctacttctgacctatattcctataaaataataagttcatattattttaagctaccaaggatatggtaatttgttatagtagcaatagagaacgacaataagatgttcattgtatcacgtacttgccttaatttttagtctttaaggtcttatgactttcacagttcaattgtaaatacatttgtggtttaatgttgctgaggctactctttcataatcaatgtaaaaataagttacaaaaactaagcaacagatacataataacaataaaaactcaacatgaaataattattgctacacatttcaaagtccaaaatggataagaaatgtaaattcaaaacagagatttgagagagcagttaataatagtttttccatgttcatagggcatatgaaaagttaaaatgattaaaagtaacaacagaaaatgttttgacaagcaatattcttcagtagaataaaaacaaaacacatcggctgggcgcagtggctcatgcctgtaatcccagcactttgggaggccgaggcaggcagatcacgaggtcagtagttcaagaccagcctggccaatatggtgaaaccccatctctactaaaaatacaaaaattagccgggcatggtggcatgcgcctgtagtcccagctacttgggaggctgaagcaggagaattgcttgaacccaggaggcggaggttgcagtgagctgagatcatgccattgcactccagcctgggcgatagagtgagactccgtctcaaaaaacaaacaaacaaacaacaacaataacaaaaatcagaaggagacaaagtataggaaaataatggcaggaggtcttaaaatatgatccaaactgtggagtatgagggagaaagaatgagtccgtgaaacagaaggcaatgcaagcacaatgacaagcatataattctatttaaaaacgtctgtgagaccataatctcccttcacttctccctgtctcagagaatatcatcatcacccacagcttgcccaaataacaaatgctggcatcagcttcaatttctccttcttcctttgtcatcaactcccatccctccaatgccctaaaatctctctatcctcccagctgtgtatctagtttgggccaccaccacaatttacctgatttattgtaaagcttcccaacttctctcctggttcctggtcgtctcctttccatgttccattcttcaaacctcttccaaggtgatcattttaaagcacaaatcaaatcatatatccctagttaaatcctccagtgtcatcccaggcctttgtcatgaaatttaaactccttagtatggattataaagtaactcttaataatctaacctctttctctccttcctccaacccagtattttattcaattataataaactttttttttttttttaggtggagtcttgctctgtcgcccaggctggagtgcagtggcatgatctcagctcactgcaagctccgcctcccgggttcacgacattctcctgcctcagcctcccgagtagctgggactacaggcgtccgccaccacgcccggctaatttttgggtttttagtagagatggggtttcaccatattagccaggatggtctcgatctcctaccttgtgatccacctgcctcggcctcccaaagtgctgggattacaggcgtgagccaccgcacccagcctgtaataaacttcttacagctctctagatgcatcacaatttttctagccactgagcctggcacaggcagttttctttgcctggaatgctccctctgtctgtccttgtgggccttcacctggctaatcttatgcatgcttcagatcttagctaaaaataccactttgtctgagaattcttccttgatcaccaaatttaagtcaagtgacactcatgggctcccataacatcccataaccatatactattttgtaattgcctatttatttccctgtctccactactaaaatgttaattccttataaggcagtaacttgatcctgaacagtaaatgaactattacaccatgcaaaatgcctcatacatagtaggctctcaataaagatttttcaaacaacaagtaaaaaatgtataacatatttataaaaaaaagaagaagaaaaagaagagagtgtaaatctcactaattgtttccaactctgactagatgctgacattttctagaatgaatgtcttagtgtatttggcctgttatagcaaaatgtcataaactgcatggcttacgaataacagaatttattcctctcaattctagaggctgggaagtcctggaacaagttgccagcagagatgtctggtggggattcacttcctggttcatagacggctgtcttctcactgtgtcctcacatggcagaagggataaggaagttctctgtggtctctttcataagggcactcatcccattcatgagggctttgccttcccaatctaattactttccaaatgccacacctcctaataccatcacacaggggattaatatttccacatatggattttggtggggtgttggtggggacacaaacattcagtatatagcaatgaggtaagtaaagtttcgcttaagaaaccaacactaataaattttatagctttttatcctcagcggaatgccaagtagatgtgcaacacttaaagttacctttcttcaaatgagcctcagcaatattaacgaataatcacaagatttcctgcttttccttcaggaagcagtgctaaaatgttagtcatgtaaaaaagagggcctcgttatttctcccctcttcctctactgtgtaggtttaacacagcagatgcttttccctcccccagcccaccttctatttcttctctcctagcctaccatttccctaggttgaatctaactcattattgatgctgactatatagctgagcctaacatagatttggcttccgaattcttctaagaaatatacaaagtatattttcttttgccatttttactatgttaaccaataggaagagcttgacctgatttctagctaaatattctttggaaagttacaaaaccagatttcccctaattccctagctgtacattttcatgacattaaagtatttggaggtttaattatttgattgtggaaaccatttgcagataaacgagatactgaaatggttactattataatttgactattctctgaatgttatcttgttcttgcattaccagtacaaatgcagcagagtggtggaaattttgcagttctacaatgtaaacattctcagacattaaacaacactgtgaagggccaaagtggtgatcagtctcagtaaataccatttagaatggcttttgtttcacaagctccaacaaacagaaatgtgccccctatatgactttacattttagcactaagatacattattggaagtagatcttattgttaccggaaattagtaattattctccaaccacatagtgcccattgtgtattatggtttttaatcataaaaacagggaaagtgtttagttcttatggtctggttcaaaactattgtacatcatacccagtagttttcaacctaatgacaaaaagtcaagtagaacagaataaactttaggaaagaaatctaccaatactttatataagcagtcatgcaataaaggacttattggattatagcttctctgtgcttcctaattaactagtcaacttatatgcaaaatatgagactgaatttctctgtgactctacatacattgtcatcatctttgtatcacagctgacagctcttttatgacaaattttgttctgaaaaagttaatcaaaattccatttccaaaatcattaatatttagtattgttgcattaagtcttatttttagtaaggcagaaattttttccatgtaagagaatataaaagactcttttaaaaattatcccaagagttttatttcattcactaaatcatattaacaatttgctaagcaaagtcgctgctggaacagatcattaaatagaaggtaaaaccttagcatgcccacctctgattccaggatgttggacattactatgattctgaataattagctcaatacagaaaaaaaagcacagtaataactatcacttgacaactaccatgtcatgtctatgtttccatagagatacagtcatttaattcctttgcctaacagtcaccgttttaaagtctaatctgagcatctgtctttggatcaatcagatttatgcatttatatttattataattactggtacctttggatttatttctgacagactattttatatttctatttaccacattttctgattatttcccccctctccttttctatattccactggagagactattctgctgctgctctgtttatattcttccagtagttaccactagcttattgatagtacacatctgtttacttttccttaccattttaaagcctatccatagctaaactgtgctttttaaaaaatgatagctgctagctgagagggtaaatttctgttgattagaaaaaggcaacccttcctcaagaaaataatcatttaaaaattgtctagagggttttccagagccctggcaggcaatagccttacctagctaacgtgtccacacttgctagcatctcagcagctcaggcagcacacagcagaccatgcttcaccctcgccccattccacaagtaaggcagtaatgtgaggggcagaaacgaaggccccacttagctctttaagatgtgtctatctcagatgtgacactcttgttcagcatatgcagtagtatgcagtactcaagcataaactcacctctttggtctctcctcccacttgtgtggtcatcacataaaataattctttttattccgtatgtattttaacttgttttggtcctttattatttaaactgtaagcttgattaagttacttactcgtcctaatttcccttatctcaaagtatcctgcatgaatgtcttttcttgtttaagtactttgtcttagcagaaattgcttctccttattgcagctaggcttgatgttctccaactactcatcgccaatgctgcactggaagcaggttagcaacccaacaggcaggtcaagttgtgacaattctctggaattgttggaaaaccaacaatcacacaactgggaagctaaagaaaaagtaatgaacagggcaaatttaaaaacccagaaagttgagtgttcttaccaagtttcagttgagtaaatgctgaataaaactactcctcggattgttgcaagcttttagttaatgttcaatgtttggaaaaagttgattttgatattttttgccagtattgttgtttttatggaaaaataggtttttggaggtctttgctccatctttctggaagtgcttctcagtacatcatattctgaatttctttatataaaaacaaatgtaggtgttcccggtaacctatttttcttcaagtcaaagattattagcattacaatttgaaaaggttaagataaaataatttcaactatgttcaacagtaagcattaaaaaagaagcaaagaagaaaaccttcatgaatgaatacataatctagggtgcaacagtcatcttttgattttagtttccttagaacctttcactttggttttactaacatacaaggaattttagaattattcagattttattcaaaattattgtatctttgaagcaaaaacaaattttatatttaattctaaatatttaatatgatttatattgaagtacatttttataaagccctttacttttaccctaaaggggtatgaaattttttctaaaatattactgttaatattaatctgtagccaaaaaagtaggatatttgttagttcttattacacttttgtgaatccaagtattattaaattgttaaaatattttagacacttaaaagtgagtaaactacagaaaatcagatgaatttgtattttgaatacatgaaatagaaaaactaagaacaatacaactaatacgcaacaagttttctgaaaaatatatttgaatggtaagtgttaatcagaaagggaaatcttccttatagattctgggtattagaactttgtcagatgcatagttggcaaatatttttctcccattctgtaggttgtctgtttactctgtttatagtttcttttgttatgcagaagatccttagtttaattaggtcccaattgtcaattgtttttgttgcctttgtttttgaggacttagtcataaattctcaatgtagtccagtgtccagagaggaacttaaataaatcatggagaaaaaaatatatatatcaggaggctgaggtgagaggatgtcttgagccctggaggcggaggttgcagtcgagctgagattgtgccactgcactccaccctgggtgatagagccagaccttgtctcaaaataaaataaaataaccccattaaaactacacaaaggatatgaacagatacttctcaaaagaagatgtacaaccagctaactaacatattaaaaaatgctcaacatcactaattatcagagaaatgcaaatcaaaaccacaatgagataccaccttacgctagtcagaatggctatgaaatgactaaaaagtcaaaaaataacagatgtgggcaaggttgtaaacaaaagggaacactcatgtacactgttggtggaattgtaaattagttcagctcctgtgaaaagcagtttggagatatcttgaagaactaaaaacagaactactttttcacccagcaattccattactgagtatgtacccaaaagaaaataaatcattctacaaaaagacacccacactagtgtatttatcacagcaccatccacaatagcaaagacatagaatcaacctagatacccaccaacagtggactgaataaagaaaatgtggtacatgcacaccatgaaatactacacagtcataaaaaagaacaaaatcaagtcctttgcagcaacatggatgcaactgaagaccactgtcctaagaaaattaatgcagaaacagaaaaccaaacactacatgttctcacttaaaagtggaagcaaaattgggtacacatggacataaagatggtaacaatagacactggggactccaaaagaggctagggtgggaaaggtgcaagagctgaaaaactacctattgggtactatgtttactatttgggcgatgggtttaattgaaacccaaacctcagcattatgcaatatatccatataatatacttgcacatatactccctgaatctaaaatttttaaaaaattttaaagaaagggaaacttcactataggggaaggggaaaagcatcaactttaggaacagaataagttaaatcagtaactaagctggccagccataatttggactggaagatcaatactatgaagagaaaacttgtaaaactgtgaaatagtttatattctcatattcttttatgactgagagtgataaaggacaagaacacggaagaaatctgaccaaattaatggtcttagtcaagactgcattgcacacattccatttctactttttctaacaataggaaacctcaacttcttactatggcattataatgaaaaaagccacaagcaaatgtagcaatcagtaaataggtgctcagtgtgatgcagtctagttagcaatcttttagtggaaaatctggggaggaagtagagggatttgtaccccaggcaaagaatgacattacaatgagaaaaaatctgatttatatgtaagattatcatatatcctggtttgcctgtggcaaacctgtttaagcctgttaacttgatttaattatttatggttttacatttaattattaatagtttctcttttcactctcaaatacatcacaatttggacacaaattatatttgccaaatatacagtcactctatttacatgtgacaacttgagcctgacacctgttgcttctctggctggctgctgtttgaatcaaggtggctaaaattcctgtcacaagccatcctcaatgtcatatctggtctcatacaggctacttggaaggaattcccagatgctcagaaaacccagactgtattagaccattttcatgctgctgataaagacatacccgagactgagaagaaaaagaggtttaatggtcttacagttccacaggctagggatgcctcacaatcatggcagaaggcaaagagaagcaagtcacgtcttacatggatggcagcaggcaaagagagagaaagcttgtgcagggaaactcccatttttatttttttttattacttatttatttatttattttattattactattgttattatttttttttattatactttaagttttagggtacatgtgcacattgtgcaggttagttacatatgtatacatgtgccatgctggtgcgctgcacccactaactcgtcatctagccttaggtatatctcccaatgctatccctcccccctcccccctccccaccacagtccccagagtgtgatattccccttcatgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacacacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaaatgttcctatttctctacatcctctccagcacctgttgtttcctgactttttaatgattgccattctagctggtatgagatgatatctcatagtggttttgatttgcatttctctgatggccagtgatgatgagcatgttttcatgtgttttttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggttcgtcaaagatcagatagttgtaggtatgcggcattatttctgagggctctgttctgttccattgatctatatctctgttttggtaccagtaccatgctgttttggttactgtagctttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtgtgttgttggtgtataggaatgcttgtgatttttctacattgattttgtatcctgagactttgctgaagttgcttatcagtttaaagagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccaatcagtatgatattggctgtgggtttgtcatagatagctcttattattttgagatacgtcccatcaatacctaatttattgagagtttttagcatgaagggttgttcaattttgtcaaaggccttttctgcatctattgagataatcatgtggtttttgtctttggctctgtttatatgctggattacatttattgatttgcgtatattgaaccagctttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttgatatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttttgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtacgcatttagtgctataaatttccctctacacactgctttgaatgcgtcccagagattctggtaagttgtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaagtatgtggtcaattttgaaataggtgtggtgtggtgctgaaaaaaatgtatattctgttgatttggggtggagagttctgtagatgcctattaggtccgcttggtgcagagttgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatacttaggatagttagctcctcttgttgaattgatccctttaccattatgtaatggccttctttgtcttttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaatcctgggttgaaaattcttttctttaagaatgttgaatattggcccccactctcttctggcttgtagggtttctgccgagagatccgctgttagtctgatgggcttccctttgagggtaactcgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagattttgtcttttcacatagtcccatatttcttggaggctttgctcatttctttttattcttttttctctaaacttcccttctcacttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcctctctcagctcgtcaaaatcattctccatccagctttgttccgttgctggtgaggaactgcgttcctttggaggaggagaggcgctctgcgttttagagtttccagtttttctgttctgttttttccccatctttgtggttttatttacttttggtctttgatgatggtaatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctggacaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgctttttaaaccggtctgaaaagcacaatattcgggtgggagtgacccgattttccaggtgcgtccatcacccctttctttgactcggaaagggaactccctgaccccttgggcttcccaggtgaggcaatgcctcgccctgcttcggctcgtgcatggtgcgtgcacccactggcctgagcccactgtctggcactccctagtgagatgaacccagtacctcagatggaaatgcagaaatcacccgtcttctgtgtcgctcacgctgggagctgtagaccggagctgttcctattcggccatcttggctcctcccccggaaactcccatttttaaaaccatcagatctcatgagacttattcactatcatgagaacagcaagagaaagacccacccccatgattcaattacttcccaccaggttcctcccacaacacttgggaattttgggagttacaactcaatatgagatttgggtggggacacagagccaaaccatatcacagactgaaagaagacagaagctaactccctcatgctttgagcaggggttcaaaaccatcaggaagctcactgctggacttcctttctcttctcagccctcccatcatcctggagactaagcaggagagacaggcagcaaagagatgggaggggaagccaagaggaagtcaatgagcacattctccaaaaatgcaatgctttagtttttcagacatctgagagagaaatggggacacatttcattctgagctgagacactgttttcaggtttaagtatatatgtgattaaatgatatttaatgattttgtactcctttccacttagttctcccatgggctccataaaattatttctttttctctttaacccactgttaaaaacctgtttggacacactctctcataagaacttatgtgtaggatgtgtaattttctttttctattttttttttttttttgagacagagtctcgcagttgcccaggctggagtgcagtggcacgatctaggctcactgcaacctccacctcctgggttcaagcaattctcctgcctcagccttctgagtagctggaattacagacacccatcaccatggtgagctaattttttgtatttttagtagagacagggtttcatcatgttggccaggctggtcttaaactcctcacatcgtgatttgcctgcctcagcctcccaaagtactgggattacaggcttgagccatcgcgccaggccaagacgtgtcattttcaataaatcattgaagttgtacggacttactggtaaaatgaggttctgtcttgtccccatttgccctgctgggtgcgtctatcgaagttactttgatctactttatgcttcctccttccttggtgcttttcagagtgcaacacaaaacacactgggttatcacagttcagctctaattctgtgagaatgccaataatgaggatgatcgattgatgggtaatagaacaaagccttgcatttgaaatgtaggagacaccttacaatagtaaaaacttaagaggactcaaaggtcctacaagatgaactcaagcactttttcttagaaaacataccatattatcatcagttttaattacaaaataataaatattagcgttattataaattgttcaaatttacaaccattctgttaacatgtgataacttgagcctgacacatagctgtagttttgcagcaacatagatgtggctggaggccattatcctaagtgaattactcagaaacagaaaaccaaatagtttataagtaaaagttttataaaatataaactattttatagatagtatacttcattgcaattacaacaaagagtatgttttctttaaatggagggaatatcattgcagttctcctttcaaaacaaaggcttcagagaaatgattaaccaaaagatctatataatagaaatcaattgtttcttaaaacactgagttgagttgattctgggcaatttggaagagaagctaccatagaaattcaaatttcccttaaaacaaaaaggcagggaatacataaagaaaaaattgtaatgaatatgtgaacaaagaaatattaatttcaattctagtacaaagtaaagaagtttttaaaacaattttttagcccactagtattgtgatgatcaatattttcctcattgtttatacactcttgtagtaacactgcatgcctgtatcttctacatgaatgaaacacaaatgctggaacttaaatattttagtaaatatttggtccaatctattattaaagcaaaaaaatagtcaataacacaaattttgggacaaatttggaaaagtctgagaggattaaattatctaatcaatcaagttctttccttatatatcgcttttattttgaagcaaaacctataattcaggatagaactttctctattaaaagccaaagctaaaaaatggtcatattcaacctaaaggaaggcatatgatctcattttgacagctgtctacagtacccttatgtgtaaggctccagtcaggacatcagcaagagtaaaatatgtacaacatttggccatgccttccagaaacccttgtgtgagagaggcaagtcatgggtaaaaatttcattgcatttgtagaatgttgacaaaatattgtaagtatatgaaagaaataaattttcttttgagcagatctagaaaaaattcttaaaagtggtggtagtcaaagtaaatcttatgcaataagtcagatgtcagcaattaaatgtgagccctgacattcaaagaagacacaggggcacacaaaggatacaagaaatactaagatatgctggtgttttcaagcataaacttctagaggtggaattttttcctaacacttatttcaacacaatgcacagatatgaacttaagacgttacttggtgatgatcattttcagtcactttgcccaaacaaccccacttcctactttatatgttcaagcagtagctaagaacaaagaaagtgttttcaaatatgaattccaaggatgaagtaaactggtataatgattaaatacacagcatttagaattaaaaccaagttcaatgcctttctataacaccaactatttgaccttggaaagatgactaaataatttttatgcctcattttcccttctattaaacaaaaataggataatagcatctgcttcatagcattgctgtaaatataaaaggaataacacgtaattttcacatccccatttcacagttaagaattcattgcatttctccaaacatatatatttgattacagtttttaccaagttacctgtgtttatatttttatactgatggtctccactatttaccttccagattatggtttcttaatataagaaaactatacacatgactctgcagaaaatagtagggggtatttctggtagaagggtcatgaaaaggggagatgatctagagctgtttgcaaggagctgatttgtgtgacagaaccaaaaattaaaacaaaactccacacaatgcacaaaggcagtgatgctgttcaccttgacgaagaggtacaggaacattttggggctacccagcaccactcatttcatgaaaatctgacaagtcaccaagtcacttcctagagggcaactcagaaaactcccactctgcaccgggtcctgagcacacctcctttcccacagctttacaacagccctagtgcctcttcctctcagtcacaaattctcaggcttctccccttttttccttttcctttttttttcttttttttttttttttttgagacggagtctcactctatcacccaggctggagtgcagtggcatgatcttggctcactgcaaactccgcctcccaggttcaagcaattctcctgtctcagcctccctagtagccaggactacaggtgcacaccaccaagtctggctaattttgtgtatttttagtagagacagggattcaccatattggtcaggctggtctcaaactcctgacctcaggtgattcacctgtctcagcctcccgaagtgctgggattacaggcgtgagccactgcgccccacttaggtttctcccttataaccagtcactaaagctagtctttccaaggaaggaggatactgatgtgtgtgagattttaaaggaagaataaatattccaaataaaggtaagatgtactgggcacccaagttcaaaaatgttgtatataacaaaccctgcttgaccaaccagtattcctctcccttttcatttgtctttaggcagagcctttgtgacagttaatttattctccaaggacattttgaaaccctgttaatcttagctaaaaggaattaaaagactacaagatcagtaactgatacctccaaagataaacttgtatttgaacatgaaggaaatattcataaatttgcccttcttcactctttttggcatctccagataacactccaagtctgagtatttattatgaaacataaatttgttgttggagccggagaggtgtcagatattattcttcttcctggatacacagaccagacttcccaaccccattccagttaggagagggcactgaatgtgaacgcatgttatccaggcgtgccccataaaaacccactaagcagtcctcctcacttctcactcccctcctcactcaaatggagacactctcagtgaacttggaagccactctttaaggaaagtagggcatccatcacctcaagtctgaggatgagtaggtggctgtgtctctgatctgtcaactctctaaggactattacatgaatcagtaacactgttttattgtatttaagccattattcatttggaagtgtatttacgacagcagttggaccctaactatagagaaagactcaattagggaagaatagggaagtatgttacaatgtgaatagatgcttcacctgtataaatggttgttattattgttgttgtttgttaacttctttgagttaggcttataacaacacagctcatctcataatgtaggaaaacatgttaaggtcagtaaactatcctaagattctagcagctaaactcctttctgaattcacaacattagcatagaacatcagcaagcctataacaattgaaaggagactctggtacgattaataatttgtttacttgactctgtcaaaattttaggtgagtcataaaaaggatatgatctcataaaatttaatatcacattttacacacacactgaataaaaccaagcaaacagtagcaaccacagctctgggataagaggggctacaaatctatctacaggaggtgctacatattatcaactgatatatctaaacacttagtttgtgtccaacattgccagaaattaggaagaaacaaaggactcataacatacatttataaatttcaccttcacagaagttataatctattaatagctgaagaggaaagattctcatacatgaagtagtacaaaaagagttatttaagtaccatgtgggttgctctgagaactaaatgatgtgagaattcaagaaagacatatttgtgggtataggtatcttctgaaagatttcatggagggattgtcctgcagaaaaagaatttgaggtttagataaagacagaagtaaaagacacggtagaggggagtggatccgtgtacagcacctgagcatctgagctctcaatagcaccatcaggatttctttcaggttcgagagaagctgacacccagcttctttatcccctccaggatatctctgggctgtgacttagcagaatgggaaaggttttgcaaacattccaggaatctagtcccagtttaattacttactatttgtgggtccttgaacaaatccctctgtgcctcagtattctcctctgtgatactgggatagtataaggccaaggctgtctttcttacaggatcaaattggccaattaatataaaatgccttgaaaatgtaagaatgtaagagctataaacatgtaagtattattaccatccccaccgtttgtcctgctatttgcaaaagcagaggaaagaactgcagcttagatgagttctgctatcctcagggccacatagctgggtatgcaaggtaacttttctcttactctcacttttatttggggtttcacagtgggcacagtgcaccagctatggtaatgcagttcaattatacagtcagagggcctttgggggcaatttgaagacttcctggatgaacactctctcgactgattggttgcacctactgtttccgtagcaactttagatcgattccacactcactgactttctgctcccatttgctataacatcactttaacatcaagagacataaggtagaaggattttaacaaatggaagtataatttaaattgaagttttggggttttttttttggaggtcccagagttctctacatgttacccatagttatagtagactcatagctctttcctttaagggaggtggatgaaagcagatgcttctttaataaaattccttgtaataatattgagaaaacattgcccagcacatcctctcccacatttgcatgaacaaagacctctagccaacctttagtttaccttcttcaccaagacttgtatgtcaaggttccaagcaggctcacaacaaccccataaggtagtatttttcccaggttatttaggtttaaaatatttgactaagtggcagtgctgtaaggtatataagtgacagagccaggatccaaacacatacataagtgtgtcttgaccatgtgaacgtgaccacaccattggtggttgtactctcagtacagcataatcatcatacttctgaatgttggtaaataactctggttcttagtttggatttccttagaaaacagagcctgaggcaaagactcgggtgcaggcagtgtattttggagctgatcccagaaagcaggaggaagtaagtggagagagcaagacaagaaagaggaaaaactgttattcggtgtgttataaaggttactgatggatggattctgggttctactttaaacctctgaggaatatataggatgtcttctaggattatccaggtggcaatggaagactggagtatttatgtgctagtctcacccgtaacccctttggatgagtgttattcctgggcatttttaacacccccacactttctggctgttcttgtgcacaggataaggagctaccaggacaccagagaagaccttgggctaaatcacagaaagacccataactgggctccaagtggaacattagctgtgttgagctaagactgaatcatcaggtaactgtccactatagctgctgctgaaattgaagctggacccagtgactgtggtgcaggcaccaggggtgtctgcctcaccctacttctaagatattttacagcttgctgaaataattattagttcagccttgtgacttgcacagtcacatgtgacatgaacgtaaccttaattctggctacagagcagcactgtcacaagacacacagttgattcatctgtgtgtctggagtagtaatcatagtccaagtgtgggctctggggcaagactgcttagttctactctgagtttcatcatggtaagtctaagtgcacaagtcacttaaatacaatgtgtttcagtttcctcatctgtaaaatggacataatagaatctaccttatagtttgctgttgggttaaattagataattagatgtaaagcactcagaagagcatctgaacatagtaagtatttaaaggagtcaatagaattttttcaaattatttgcaatttactaacatatccattttttctctcatagcaggaagggaatgtattataagcactctgtgccttcccactcatgattataaaatgctaaccaaaagcttaacataaaataactacaagccccaaaaccaaacatcacagtggcaggaaatttcaccacccaaagcccaccactttcttagcactttgtcttaaaataatgaaaactgtttggtagctttcctctctcacacgtactaaaactaaagggaacatttttaaagtttaatatttttcacttggtaaaaatccttattctgatagaataacatctggccagagagggggaaaaaagcaaccagcacaggagccgagtagcttctggtctccatggtaacagtgtcccatattctgacccctttaatcacctgatcctctcaggataatgaaaggagcaaggagacaaaaaccttaagacaaaaaaagtagccattcttggagccgatgatgacaagccagcaaatgcagcccagaggtgattctaactacctctacttatgtgacattcccttagaattatattttcagtaggagtgataggttaacattgatcaagcagagcttagtcaaaattgctcattacccccttgtaagcgacagcacataagcaagatggcaccctggggatagtgggcagtttgctgccaagctgcaagataattggtctccacagaaatgaaatttgtgatatttttctccttaccttatgcctttacctgatttctaggaaagatattgaacattttttgaaacattagagcaatgcttctcaaagcaagaaccacggagctcctgcatcaggatccctgggggcattgttaaatgcgcattcccagggttcatcttcggtagattctaatagagcaaacctggaatgcagccaaggaagttgtatttaacaagcagctccagggggttcttatgcaccctatagtttgaaaccactcacttagaacgtgagagttactccctccactctgcaatttatgttggcattcagatcatttatgaatgtgacagattcttcttttctacagatgacctatggagataatcaatttttgagaccaaaaaaaatatatagggaagcatttagaactactgaagtgaaaggaaaaaacatctatgtttaggaaaacaagtataaattaacaatgaaaagtataacctattgcttgactaattttatttgcctatattgtctcaccagttataatgtctgtataattatcatacagagttccttttactttttataagagagaattcctatgttaaaggacagaaacctaatgctataaattactaatctatttcatagctcctgaaaaattatataagctgtatttagatggcatctgattttattcatatattcacatattcaaatgtttactgagcatctgctatgtgctggacttaaagaagccaaaagcccccactaccacagagtgcattctaggaaggaataaacaataaacaactaagtaaaatacctgctgtgtcagatggcgaaaagcactatagaaaaatataaagcaagggatgaggtggttgcagttttaaataactgttatgggaagacctcaaaaggaaatggcatttgagtaaaacctgaatatgataagggaacaaatattacaagtatctggtgaaagaatgttcaaggcagaggaaatatcaagtgcagaaggcctgaggcagaacatcccagagagtagtgtggccagaacagagtaaatgaggtacaaagtagtagataaggtgaaatataacactcctggtgggagaaggtgggacatattgtgacctttgactttcattccaaataagaccagaagaagccataggaagattttgaactgagaaattataggaacttacttacatttaaaaggatcagtctgcacctgagttgagaatagacaaggacagagaaagggagaccaataaaatggcattctagtactttagatgttgaataagactatattgtcagcttttgtagtagcaagaaatgttaagagtctaaaaaagttttgaaggcagagtcaaagagatttattgacgaattgaatgttggatcaagaaagagaggaatcatgttttttatctgaggaagtggaaagatggagctgccttttcctagatatgaaagagtgtgggcaaagcagcgttctaaatgtgttaagattaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggctagggacatgaacagacacttctcaaaagaagacatttatgcagccaaaaaacacatgaaaacatgctcatcatcactggccatcagagaaatgcaaatcaaaaccactatgagatatcatctcacaccagttagaatggcaatcattaaaaagtcaggaaacaacaggtgctcaagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtgtgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacatgaaggggaatatcacactctggggactgtggtggggtggggggagcggggagggatagcattgggagatatacctaaggctagatgacgagttagtgggtgcagcgcaccagcatgacacatgtatacatatgtaactaacctgcacaatgtgcacatgtaccctaaaacttaaagtataataaaaaaaaaagaaaaaaagaaaaaaaaagattaaaatatctgttagacatccaggtagcaacgtcaagtagacagttggatccatgaatctgaaattcaggaaagatatctggtctggatgtatgaatcagtgaatcaccagcctcgacgttatttccaagggagttagtgtaaatggaaagagaaaaagttcaatgtctaagtgctggggtacttcaacatttaaaggtccaagagatgaatagaagctatcagaggaactgagatggagaagccagtgaggtaggaggaaaaagcactaaagtggaatatcctacacattaaatcagcatgtttcaaagagattggagtgatcaacaatgtcaaatgcttgaaggtccataagatgaagactaggaagtgaccattggatttagcaactggaggtgaatgacaatcttcattagagcagttagatgtactggtggtatcagaattctgatttaattggattaatgaaggaatataagagaaattggagaaagccagtattaaaaaattcattcaagatctcaacactaaagaggaggtgagaaatgggtgataatgaagaaaaatgatgaggtcgagagaagtcaggttttcttttcttttatctttttttcttttcccttttttccttcctgtttttttattcttcttttttcaaaatatgagaatctaaagaatgcttgaaatctaaaagaatattcaagtaggaagaggtgctttgattacaaagactagagggaaaaattgttgagccaatgcccttgaataaaggagaagtgatgggagctagcagaagacatgtggagggagtagtctcagaatgtttttttcctttagcaataaattgttaatctataacatcaggggagaaagcagttgcgtacagctgtatagaagtcatggtggcagcttataaaagtccttcctcttctatttgctttttttctcattgaaatgagaaacaaattcattaacaagaggaggaatggtgaaaaggttttggaagtttgaaggagatgacggtaagaactatgtcgtgatccagaagactgggcagtgaatggacttgggaaatgcggtatgtttgccagcagcattaatgggtcatcttcatgaatataaggtgagactagtgcagaaattctggcctaaatgtctaaggaaaagtataatttttaatcaaagcaaaaaaatctcaatttagtcaccataaaaagttttccaattcacttaagaaatttttcctcttaattttgtcaaagatcagtctgagtatttctcagtctctcttaagagtgctgagtcatgattattacccctgcctgttagaggtaaattttagagggttagttactgaacctactgggctttcactttataaaaagggaggtaaattttttaaataccccactatttccaaacctcatactgtactctctggcataaaaatctctgtggcataatttatgctgaaatgctttctaagtttattcattccaacaatatggtaaattctactcacaggaaataattctcagtcatgagcttttgaggtcgtgggtatttgtaccagagactgatataaaatttctcaaaacagaaataacattagttcaaagccacatggcatattacatatcatttatcaatgtcattagagataatattcaaaattaattaacaaaggattttgtagttcaaaaaaattaggatattttatataaatcccaggaattcttatagccagtcctgcttctgagttcttcacatatcatgagttttcattcattgctaactaattaacacttcacttcacaccttactgcattttccatttatccattggtttctgggcagtgactcaagtaagctatgagaaagaggtatcactgacatttagaaagaaaaaaaattgagatttatagctgcattgtgatttcatagacaccacccacctgccatcaccaggaatgatttcttctccctcatcttttccatagtcacacatagtcacacatcagtcacacatcagatgcctattatcacttttttttgaaactttagagtgtgttaaagctggcgagaaaggtgaggggcattatatcagttcccattttatgggacttaaatacattgtggtttttttcattttaagataccttacatgtttatatgcaaagggatctgtctctgttttgtggcatactttggtcacatgtgtgagtatttgataatgagttcttgctgccagagctctaattatagcatgttcctatggaaagagagaattcaccactctgttcacatggtgccatttcagccactgcctctttctcttttgttgaccctttgattgactaactgattaaaagactagtctataagctctaacagaaaacaaataattccaattgctagtatcataaatattatttcatattttccatttaaaaatcccttcaagatccattcaccaattaatacatcattgaatttacatttctgatctactatgggtgctccatgtaattttgacctgtgctttacatcataaacctttcctccttttgattcattcaagtagaaagtagtctagatgatggataaaagagaactctctagagtcagattatccaggcttcagtccacactggtacctgtgtgattttggggagtcaacttaaagtctgcaaaccttgtctgtaatatagagaataataatagtacatatgtctgaatgtcattgtgaggttgaacacactaattcgtgtaagatgtttagcacacaactcctgacaaataggaaaaattcaattagattagtttttactaaatgtatcatatgtcagaaacatactttatccaggctgcatagtatttagagtgcattgattctcaattcttctattccatgttatttaacctctctgagactcagtttctgtttttaaaaagataatttccacctccggggggcggttcataaagaacttctaacacatctctgacactgcattaggccgaggtgggcagatcacgaggtcaggagatagagaccatcctggctaacacggtgaaaccccatctctactaaaaatacaaaaaattagccaggtgtggtggtgggcgcttatagtcccagctactctggaggctgaggcaggagaatggcatgaacccaggaggcagagagactctgtctcaaaaaaaaaaaaaaaaaaattacataattactatctgcattagtttggaggccaccaaaacaaaataccacagagtgaatgacttaaacaacagaaatttattttctcttagttttggaggcgagaagtccaagatcaagatgtcagcaggtttagtttcttctgaggcctctctccttggcttgcagatggccgcgttctcactatatcctcacatggtttttcctcagtgtgcatccctgaggtctctcagtgtgtactattctcttcttataagaacaccagtcagattgaatttgagcctgccctaagggcctcattttaaacttaattatctctttaaaggccctatcttcaaacatagtcacattctgaggtcttggaagttaaggcttcagcatttttaggtgacacacattggcccttagcactacacttcagctttcttgttccttttcatttcacataatccaactaccttgaaaaatgcatctaaagaaataggtatttcaatgctctaggtaccataacctgaagaagtgtagaagtttgtatataaatacttccttttcccttcaatacactgttaacttttcttacctttcccctgcttcatttgtaggtactgaattttccagatagtgattccaaaaatacatccactttaataaaatgtcattacaataaaaattacatatcaagagtatttattttaaaatatcttaatattttaaaatgttaaatattttaaaaattaaaatactccatttgtgaattttggcttttgttgcaaatgcttttggtgttttagtcatgaagtctttgcccatgcctatatcctgaatagtatcctaggttttcttctggggtttttatggttttaggttttacatttaagtctttaatccaccttgagttaacttttgtataaagtgtaaggaatgagtccagttactgttttctgcacacggttaaccagttttcccagcaccatttattaaataggggatcctttccccattgcttgtttttgtcaggtttgtcgaagatcagatggttgtagatgtgtggtgttatttctgaggcctccgttccattctattggtctatatatctgttttggtaccagtaccatgctgttttggttactgtagccttgtagtatagtttaaagtcaggtagcatgatgcctccagcttcattctttttgcttaggattgtcttggctatacagactcttttttggttccatatgaaatattttaaattttttctaattctgtgaaaaaagtcaatagtagcttgatgggaatagcattgagtccacaaattactttgggcagtatggccattttcatgctattgattcttcctatccatgagcatggaatgtttttccatttgtttgtgtcctctcttatttccttgagcagtggtttgtagttctccttgaagaggtccttcacatttcttgtaagttgtattcctacatattttattctctttgtagcaattgtgaaagggagttcactcataatttggctctctgcttgtctattattggtttatagaaagaaagagcttcttcaaacaaaagaaactatcatcagagtgaacaggcaatctacagaatgggagaaaattttggcaatctatccatctgacaaagctctaatatccagaattcacaaggaacttaaacaaatttgcaagaaaaaaaaaaaaacccatcgaaatgtgggcaaaggatatgaagagatacttctcaaaagaagacattcatgcagtcaacaaacatgaaaacaagctcatcatcactggtcattagagaaatgcaaaccaaaaccacagtgagataccatctcatgcgtgttagaatggcaattattaaaaagtcaggaaacaacagatgttggcgaggctgtggagaaataggaatgcttttacactgttggtgggagtgtaaattagttcaaccattgtggaagacagtgtggtgattcctcaaggatctagaaccagaaataccatttcacccagcgatcctattactgggaatatacccaaagaattataaatcattgtattataaagacacatgcacatgtatgtttattgcagcactatttacaatagcaaagacttggaaccaacccaaatgcccatcaatgatagactgaataaagaaagtgtggcacatatatacaccatggaatactatgcagccataaaaaagaataagttcatgtcctttgcagggctatggatgaagttggaaaccatcatcctcagcaaactaacacaggaacagaaaaccaaacactgcatgttcttactcataagtgggatttgaacagtgagaacacatggacacagggaggggaacatcacacactgggtcctgtcagggggttggggggaaggggagagagagcattagggcaaatacctaatgcatgcatgacttaaaacctagatgacaggattgtaggtgcagcaaaccaccatggcacatgtatacctatgtaacaaacctacatgttctgcacatgtattccagaacttaaagtaaaatttttaaaaattaaaatattttaaaatgttattaaaatatttaataatttaaatatttaaatttaaataaaatatttaatagtttgaatatttaaatttaaataaaatatttaataatttaaatatttaaacttaaaatattttaaaatattgtatttcatttattttaaaatacgtaatattttaaaacatagaacaatgagttttatgagaaaattaataatgtgaaaaagaatcagaatactgtgaggtaagaaaaaaaatcttaactaacgtaagaggaaaaaatctttaaccaaaattgataacattaacttgcaaaaagcaactttggcaaacatcatagcttgcctatccaacagtcattcgctcttcctttgtgccagtagtaaccaaattgtgcccatccttttgcaagaagacattggccaaaggggagcttgaggctctccagaccctgtagaagaatcacgattgacctcagtcattccattcccctttgccagggattggcttaggtgcagctcagtgaatcataaggagagtcttcaaagagctctggaaacggaatacaggaaagggatagttttttccaaatctcaggatattaggatatgattcttggggcttctgcagccatcttgtccttcaaaacaaattccttttttcctgagactatgaatgaatgaaaaaaaggaagtatggtaaaatatgctaccccaaaatatgctaccttggcataaggattcttttgcactaaaggcacttgagaaacagatgatacaagagacactctgacctccccttttctcctagtatcagcaaaaaagaaacattcttgtcaccagagatggggagttgaggcagagaaaaatctatataaacaatttgtttaaaataattcttatcttccttagcttctccatgcattttcgttacttttccgtaactttcacactttcttcaccctactatgtaagcatatagacttagacacttctttgagtcttgtttttcctgtaggggctcccagttatatgcaaaatctatatgcttttctcctgttaatctatcttatgccagtttaattctcaggcccagctggtgacactaagagggtagaaataaaattttgtctcccttgcaagaataaaggttctaaaaccaaatactaactgttcctaatgttatcaaaatgccaggggtttggtgtaggtcctgctgctcaccacacagagagccagtcaccgagacaaccgctattgccagagaagaaggctttaattgggtgctatagccaaagatatgggagatcagtgtcaaatccatctttttgactggctaaaattaggggtttatatagcagggaagaaatgtaactacctgtgggaaaacaggaactcgagaagagtaaggaagtaatcatgattaatgagggacctagagtttcattgtctggatgccatgatctaatgagtttcagttcttcgatactttttgggaggcctagaggtcctttcctaaggaagaaactcagataaacaaatgtaaatttcaagctttaagaccaaaagtgtccatttctgtgtgcgtgtgttgctgttgttgttgtttaaaaaaaaactacttacgggactattgggtcagtttactaatacagaaaataatttaaagaactgctaaataacaaacagcatacattactttgacagtcaactagatgaaggtcaaggacaaattactgggggacacttataattccagaccagaattcttgaagattcaataaagaaaatgtttatattagtgggaaagacaagtttttctcagttcttttaaaaaacattatttttcaaaattaatcttttgttttgtttaatggtattttacattacacaaatacactgaacttgaaaaattgactgcttaaacaaagaggatctagcagtaagccactacctatgggcacaggcaaaaccggcagaaaggatagctctgctattgtcagcatttgacgtcacctcttgagaatgaaaaccctaaagatattgtgaaaagaacaattatgagagcagtgttctccctttggtctatatcagtgacactggagtatttttaaaatatcaatcaatctaagttttgtatagtcagaaatgtcaaccctttatactgccctctctctttcatttttgtggtaccataattacctgtctatgtagttaaggggtgggagagttatacatcatcatgccttatgaaaattgccaagtcagatgacactacaagatactcagcatccaaccaggaaactctaggttccatgagaatggaaattgggtctgctttgttcagctctctatcttcattgcctgtggagcttaataaatatttgctaaatgaatgcatgaatgactgggaactaaaaagataacagtgtatactaggttccacccccccccacccctgattactatacataactatttattatccttcatggtacaatatgatttttgcctgctccaagatgattcagaaccaataattaccattaaatttccaattcaatatctagattttatttataatcacttttaatcttccagtatttcaaaatttttcatgtgtctcctataatcaccttgtatgaccttatctacctgtgatgtgccatcatttcacaacagaccactttaactgcattcagtaagtaaaactatggctcttcacaactcctaagaaagaagaatttacccccattttgtttttaaggaggtaggaacagaagatgtgacaaaacaggccagaaaaaaaaaattgatcatgttgactatgcactgtaatccagtaatcacacaaatctaagtggcaagatgatcacagtcttttggtgacaggcctcattatcttaaagagcaatttagcaggagtgagcaattcatcttgttcagtgaatggaaaatgttggagtttaagagttgtcatttttataccatctgtagacttgcatgcagagaaaaaaaactcatgaagtttaaatctaggtaataatttatttgtggtagacacatcattatgtaagcacataaagttttaatttgaacaagttaaccctcccttgctggaccaatatccctattctcttttgagggaatgtggtaaggaacaaggagtggtggagatggtggtgaagggtgaggaagtttctgctccgctctcgcttcctgcactgactctaaaaagtgagtcagattgtctctgggagcaaagaaatttaccttaaaaaagtatggaagattgctcatcttggaaaaagccaaaatgtttttggctagattataggcttagaaacaactagaatacccaactcttcacagaaggctgagtaatgatttctgcctttccaaatctctgtggaagcctcttgggctagtataaagggtaaataaatgagtgttcctagaaacagcagtaaaggaacaagaaatagttaaatcttctacatggtaattcagtgcttttaatatacttacacccaatattctcattttcaacttttaaagaaacatgaattaatacttgacagcaagattagaaatacaaattagcctgaaaaatgtaagagaattagtgtggtgtgaaagacagcagtacaaattctggagtcagacacatctgagtccaaaacccagaccctccatttctaactgtgccaactggacaagctatttaacttctctaagcctcagtgtccctgtcattagaagagataagaatgtttatttcatagcattgatttaaagattatatgagattatttatgtaaagcacttcccagagtgcctgaagttactaaacattcaagaaatagtacctattattatgctactaataataatgatctatattcacatctcacaaataagtgctgttaacattttagcatgtagtctttcattttgttttctctaagtatatttgcatgtatttttaatacaataaagtgattgtactatgcataatgtctgtagctttttttaagcagttaataatatattgtgaccatcttgacaataaagaaagtgtcataatcaattggcaatggctacactgtcatcttttttatgcctttacaataatgtattttactgatccccttatagctgaccatttaggatgtgcgtacatttttttctatgataaacaacgcctcccacagtaagggaggaacaatggaatgaaaaactctgcacataaacactttgatataaattctcatttggttaaattcctgcaagtgaaatcactgggttaaacaaagtatatgtgcacttttttttagatttcttgacacattttgacaaattcccttccagaaaagactcccacagagaagttgtgagattctcttttacaggaactttatccacattgggtattagaatttccctgtcaaagaggaaaaaaaaaaaaagttgccaaagtgcttcattgctgtcattgtgaaatgaaagcacattaaaggatcattgaaatctaattgctgttttccagttgaagtttattctagagcaggagtccacaaactatggcccattggtcaaatctcccctgccatctggttttgtacgtcttacaagttcagaattgtttttacagatgaacatttgcaatatatttgatcatcggaaacactaatttgtaccccaattaattaatatgttatttttaaaataagaattcaatttttctcattagctagcctgtagtacaaaatcttgaactcgatgattatgatttactttaaattttgtcaaagaatgttatgaaaatttgttttctcccttgttataataagtatctacgtaatattctcgattttgcatcttgacctacaaaggctaaaacatttacatctgtttacagaaaaacacaatttgccaaaccctcttcaaaagtattaattaaaaacataaaaattttaaaatattttaaagtatttcacctaagatactagagtaacaaacttacaaggatcgccctttattccacatctcagtgattttcaaacctgaagttctcagtttccccagagataattttgggagaaaaatgagggcaaacaaaagtcaacaaatcttcacacttcaaccatttttattgcctcttgttttagatttgggttccaaataagatttcatgtaaataatttgccccacaattttagaaagtgtctgaaaactgcttgctaatgtgtaacagggcattgcttaggccagggcttcttctacatgtcttcaaccagtgcctgtcaatagtagagttcacaatagttaccagcccacctgctttcaaatcaaactgacctacttttttaagggtcatagttctaacagatgaaacatggctaaagaccaattttaataaatctaaattggtataggtaatgttttcgtctttcaagagaaatataaccttgattcatacaaactatttcacacttaaaatggttgaacaagtatttccacagtaagggaggaacactagaatctgaaaggaacaaataagcatagaaccaaaaacgtaagccttactttcctttgtttttctgagccatttattcaggttgtcagagcaaacttaaaatgaagctatcccttgactctgtagccatgtaatgaaatggttaggagcaaaaaaataaacacagaaataggacttggttgtttttccattaactgtggctttcttgatgattgtgcatttccagaaggttaaacataattgcctcttctcccttcctgaagctcgtttagatacatcctgacacattcccacacacatagctcttctaacctaaggttcagtttggcagggaaattctttcaaatcagcaggaaagaaaatagtctgttatttactgggtatatgctattcaaaatcaacaaaataatagatcaattccataacagaaactttggacactagaattaaaatttctagaaacagttaatactaaaattattctcattctggaatcaggtagctcaagacaatgagaatataatcaatagaattactgaaagagtaatagtgatgacagcaatagctaacatttgggtgcttgctgtgtagcaaggccagtaagtcatgaggatcaaactggctttcaatagttataacactcatttattatcaaccaagccctcttctaattccatgatatgtattcactgcctcaggtcaatggcacctatgaggtaggcaccattattacccacattttatagatgaagcttagtggactgccatgctcaaggagctggttcagtacacagtggacctgggacttgacctagggctcttggtcacagagccacttctccctctcaaacctgcctgatgatggaatgtgggaatattctagcaggataatctctattcaaccatcatggaaatagtgaataacacggttttaagaaaaaaggggttcgagaccagcctgaccaatatgatgaaaccccgtctctactaaaaatacaaaaattggccaggcgtggtggcacaaacctgtaatcccagctactcgggatgctgagacaggagaatcatttgaacctgggaggcagaggttgcagtgagctgagatcacgctgagaggtgacagtgtgctggcagcccttgcttgctctcggcgcccctcagccttggcgcccactctggccacacttgaggagcacttcagcccacctctgcactgtgggagcccctctctgggctggtcgaggccagagctggctccctctgcttgtggcgaggttggagggaggggcgcaggtgggaactggggctgcacacggagcttgcgggcaagtgtgagttccgggtgggcaagggctcagcaggccctgcactcagagtggctggcctgcgccaccaaccccaggcagtgagggccttagcacccaggccagcagctgcggagggtgcgcagggtcccccagcctgccagcccacctatgccacgcttaaattctcactgggcctcagctgcctccccatgaggcagggctggggacctgtagcctgccatggctgagcatcccccaaccccccatgggctcctgcatggcctgagcctcccagacgggtactgccccctgctccacaacacccagtaccatcaactgcctaagggatgaggagcgcgggcacgtggtgcaggactggtgggcagttccacctgctgcccctgcatgggatccactaggcgaagccagctgggatcctgagtcaggtgaggacttggagagcttttatgtctagctaaaggtttgtaaatgcaccaatcagcactttgtgtctagctcaaggtttgtaaatgcaccaatcatcaacctgtgtctagctcaaggtttgtaaatgcaccaatcagtgctctgtgtctagctaatctagtggggacttggagaacttttatgtctagctcagggattgtaaatgcaccaatcagcactctgtgtctagctaaaagtttgtaaatgcaccaatcagtgctctgtgtctaactaatctagtggggacttggagaacttttatgtctagctagaggattgtaaatgcaccaatcagcactctgtgtctagctcagggattgtaaacgcaccaatcagcaccctgtcaaaacagaccaatcagctctctgtaaaatgcacccatcagctctctgtaaaatggaccaatccgcaggatgtgggtggagccagataagggaataaaagtaggctgcccgagccagcagtggcaacctgctcggctccccttccacattgtggaagctttgttcttttgctgtttgcaataaatctcgccactgctcactctttgggtccacactgcctttatgagctgtaacactcaacgcaaaggtctgcagcttcactcctgaggccagcaagaccacgaatccaccaggaggaatgaacaactccagacgggaggaatgaacaactccagatacgccgccttaagagctgtaacactcactgcgaaggtctgcagcttcactcctgaagccagcgagaccaccaacccaccagaaggaagaaactgtgaacacatccgaacatcagaaggaaaaaactccagacacaccatcctcaagagctgtaacactcaccacgtgggcccatggcttcattcttgaagtcagtgagaccaataacccaccaaatcaggacacattttggtgacccagatgggactattgcttatcagcaagcagtaagactatcgcctatcgccaagcagtgagtaccatcggacacctttcacttgctattctgtcctatttttccttagaattctggggctaaataccaggcacctgtcagccagttaaaagcaactagcgtggccgctggactaaagacatgggtgtcaggctttctggaaaagggctctctaacaacccccaactctttggagttgggggcgttggtttgcctggaaccagcttccacttttcctgtgcttctgggctgagccgagggtcgacagagaggaaagccattcagctctggggtcccaacaagttggttgaccctgaggccatgagtggaactctcaaaggcatgttgcccaagcgagacgtgcccatctattctctctatcctgacccttgtcccctgggtcctaaagtctgccagacaaacttcctctcgcccctcttctccaaggctagtcttgcttctaaaaatcgctccctgtctctggtgcttttctaatttctcctataagaataatttctggtataaactccaggactctgttatgtaatttaggcacctgggctcgccaatcagaaagacataatttttgcccaaagccctgatgtagggggtactatctggaattttaagatccctcctcagacaagcaggcctaacaaaaactattcctgaagctaggatatggggagcctcagaaattgtatcctcctattcatataagtgaggacaaaacgtgtcactcttccaaccctggatatcccttccctccctcagggtatggccctccacttcatttttggtgcatgacatctttacaggacatgggtaaggtcccaatactaacaggagaatgcttaggactctaacagattttcaagaatgcgttggtaagagccactaactcggatttttctcagtcctctttgtggtctaggagggcaggcaagggtgcatgtttttgacaatgcattggtaagggccactaaatccgaccttccttggttctccttgtggtctgggaggaaaactagcgtttctgctgctgcgtcggtgagcacaactattccgatcagcagggtccaggtatcattgcaggttcctggcaggggttgtttctgctgctacatcagtgagcacaactgttctaatcagcagggtccagggactgtcacgggttcttgggcaaggggagaaacaaaacaaaccaaaactgcggatggttttgtctttcagatgggaaacactcaggcatcaacaggctcacccttgaaatgcatcccaagccattgggaccaatttgacccacaaaccctgaaaaagaagcagctcatttttttctgcactgcagcttggccccagtattctctctctgatggggaaaaatggccacctgagggaagtacaaattataatactatccagcagcttgaccttttctgtaagagggaaggcaaatggagtgaaataccttatgtccaagctttctttttattgaaggagaacacacaactatgaaaagcttgcaatttacatcccacaggaggacctctcagcttacccccatatcctagcctccctatagctccccttcctattaatgataatcctcctctaatctccccggcccagaggaaataagcaaagaaatctccaaagcaccaaaacccctcaggctatgtccccttcaagctgtagggggaggggaatttggcccaacccaggtacatgtccccttctccctcactgatttaaagtagatcaaggcagacctggggaagttttcagatgatcctgatagatacatagatgtcctacagggtagagggcaaacctttgacctcacttggagagatgtcgtgctactcttagatcaaaccctggcctttaatgaaaagaatgcagctttagctgcagcccgagagtttggagatacatggtatcttcatcaagtaaatgatagaatgacagccgaaggaagggacaaattctctaccagtcagcaagccatccccagtatggatccccactgtaaccttgactcacatcatggggactggagtcgtaaacatctgttgatctgtgatctagaaggactaaggagaattaggaaaaagcccataaattattcaatgatgtccaccacaactcagagaaatgaagaaaatccttctgccttcctcgagtggctacgagaggccttaagaaaatatactcccttgtcacccgaatcactcaagggtcaattgattctaaaagataagtttattacccaatcagctgcagatatcaggagaaagctccaaaagcaagccctgggccctgaacaaaatctggaggcattattaaacttggcaacctcagtgttctataatagggaccaagaggaacaggcccaaaaggaaaagcgagatcagagaaaggccacagccttagtcatggccttcagacaaacaaaccttggtggttcagaaaggacagaaaatggagcaggccaatcacgcagtagggcttgttatcagtgtggtttactaggacactttaaaaaagattgtacaatgagaaacaagctgccccctcatccatgtccactgtgccaaggcaatcactggaaggtgcactgccccagaggatgaagtttctctgggtcagaagcccccaaccagatgatccaacaacaggactgagggttcctggggcaagtgctagctcatgtcatcaccctcactgagccctgtgtaagtttaaccattgagggctaggaaattgacttcctcctggacactagcgtggccttctcagtgttaatctcctgtcctggacaactgtccgcaaggtccgttaccattcgaggaatcctgggacagcctgtaaccaggtatttctcccacctcctcagttgtaattgggagactttgctcttttcacatgcccttcttgttatgcctaagagtcccacacccttattagggaggcatatattagccaaggctggagctattatctacatgaatatggggaacaagttacccatttattttcccctacttgaggagggaatcaaccctgaagtctgggcattggaaggacaattcggaagggcaaaaaagcccacccagtccaaatcaggttaaaagatcccaccacttttccttttcaaaggcaatatctcttaaggcctgaagctcataaaggattacaggatattgttaaatatttaaaagctcaagccttagtaaggaattgcagcagtccctgcaacactccaattctaggagtacaaaaacctaatggtcagtggagactactgcaagatcttagactcatcaatgaggcagatattcctctatatccagttgtacccaacccctataccctgctctctcaaatacaagaggaagcagaatggttcacagttctggacctcaaggatgccttcttctgtattcccctgcactctgactcccagtttctctttgcctttgaggatcccacagaccactcatcccaacttacggggatggtcttgccccaagggtttagggatagccctcacctgtttggtcaggcactggcccaagatctaggccacttctcaagtccaggcactctggttcttcagcatgtggatgatttgcttttggctaccagttcagaagcctcattccaggaggctactctagatctcttgaactttctagctaatcaagggtacaaaatgtctaggtctaaggcccagctttgcctacagcaggtcaaatatctagacctaatcttagccagagggaccaggaccctcagcaaggaatgaacacaatctatactggcttatcctcactgtaagatattaaaacagttgtgggcgtttcttggaattaccagcttttgccgactgtggatccccagatacagtgagatagccaggcccctctgtactctaatcaaggaaacttagagtgcaaatactcatctagtagaatgggaatctgaggcagaaacagccttcaaaaccttaaagcaggccctagtacaagctcgagcttattatttttctttttgtttttttttaattatactttacgttctagggtacatgtgcacaatgtgcaggtttgttacatatgtacatgtggcatgttggtgtgctgcacccattaactcatcatttacattaggtatgtctcctaatgctatccctcccccctacccccaccccacaacaggccctggggtgtgatgttccccttcctgtgtccaagtgttctcattgatgaattcccacctatgagtgagaacatgcggtgtttggtttttcatccttgcaatagtttgctgagaatgatggtttccagcttcatccatgtccctaaaaaggacatgaactcatccttttttatggctgcatagtattccatggtgtttatgtgccacattttcttaatccaggctatcattgatggacatttgggttggttccaagtctttgctactgtgaaagtgctgcaataaacatatgtgtgcatgtgtctttatagcagcatgatttataatcctttgggtatatacccagtaatgggatggctgggtcaaatggtatttctagttctagatccccgaggaatcgccacactgtcttccacaatggttgaactagtttacagtcccaccaacagtgtaaaagtgttcctatttctccacatcctctccagcacctgttgtttcctgactttttaatgattgccattctaaatggtgtgagataatatctcattgtggctttgatttgcatttctctgatggccagtgatgatgcaagctccagctttaagccttctgacaggacaaaacttctctttgtacatcacagagagagcagggatagctcttggagtccttactcagactcatggtacaaccccacaaccagtggcatacctaagtaagaaaattgatgtagtagcaaaaggctggcctcattgtttaagggcagttgcagtggtggccatcttagtgtcagaggctatcaagataatacaaggaaaggatctcactgtctggactactcatgatgtaaatggcatactaggtgccaaaggaagtttatggctatcagacaaccgcctacttagaaactaggcactactccttgagggaccaaccagtacttcacatatgcatgtgcatggccctcaaccctgccacttttctcccagaggagggggaaccaatcgagcataactgccaacaaattacagtccagacttatgccccccgagatgatttcttagaagtccccttagctaaacctgaccttaacctatataccgacgggagttcatttgtggagaatggcatacgaagggcaggttacgccatagttagtgatgtaaccatacttgaaagtaagcctcttcccccagggaccagtgcccagttagcagaactagtggcacttacctgagccttagaactgggaaagggaaaaagaataagctggtatgcagatagcacatatgcttatctaatcctacatgcccatgctgcaatatggaaagaaagggagttcctaacctctgggggaacccccattaaataccacaaggaaattatacagttattgcatgcagtgcaaaaacccaaggaggtggcagtcttacactgccaaggccatcagaaaggtgaaggagaaaagtcagaaggaaactgccgggcagatgctgaggccaaaattgctgtgaggcggaaccctccattagaaatacctacggaaggacccttggtatggaacaaccccctccaagagattaagccccagtattcccaaaccgaagcagagtggggactttcacgggggcatagttttctccccttggggtggttggtgacagaagaaggaaaggtacttatacccgaagccagccagtggaaaatacttaaaaccctccaccaaacttttcatatgggtattgaaaacactaatcaaatggccaaatccctatttacagggccaaatctcctccgtaccatccgacaggtagtcaaaacctgtgaggtgtgccaaaagagtaatcccttggttcatctgaagtcccctttggagaaacaaagaataggtcactatcctggagaggactggcagttagacttcacccatatgcctaagtcaaagggatttcaatacttgttggtctgtatcctttacaaattggatagaagctttcccctgcaggacagagaagactcaggaagtgattaaagtcctaattcatgaaataattcctagatttgggcttccccaaagcttacagagtgacaatcatctggctttaaagccacaataactcagggaatttccagggcgctagggatacaatgtcaccttcactgctcctggaggccacaatcctcagggaaggttgagaaggcaaatgaaacactcaagaggcacttaaggaaactaacacaagaaactcatctcccatggcctactcttttgcccatggccctgttgagaatccaaaattctcctcacaaaatagggctcagtccatatgaaatgctgtatggacaacattttctcacaaatcacctcctacttcatcaggaaacggccaaattggtcaaagatacaacttctttggcaaaatatcaaaaaagcttaaaaacctactggaaggatgtcacagagaaaagggaacagagttgtttcaaccaagagatctagtgttggtcaattctctcccctctacctccccatctatggactctttgtaggaaggaacatactcggtaatcctctctactcccactgcagttaaggtggcaggagtggaatctcagattcaccaaaccagagttaaactttggacatcccctgaggaacctgcaggaccatcagctcaggagtcccaagatcagccagaccagcctcgatacacctgcgaaccactggaggacttgcacttcctattttggaaggaaacctcccagactaaaagggtccctaccactgatcctgaggaaagatcccttcctccttaaaaaagataagtgaaaacaacgtactaaccatactctttgtgataggactatatactctagctcctgccaggacaaaaatcctaatcacatcaaccttttttctatcttccttccttttgacagcaatttactcctacctttaattcagactagataaaatgatctcgttttccagagcaccctctttaccttcctatttccgctttgcctatgtatccctcctgcttccttggatacctcatacaatcacccctccccttccactaggtcctaattacctctacaagactctcaacttaactcactctctgttgaaccagtccaatccttccctggcaaatgactgttggctttgtatctctctaccaacctctgcctacgttgccactcccattcccgcagaaaaactgggactttaccaacttaacctaccaccctcattatgaaggaaaagaccctttccgatttctaaatatgcaatcattagccgacttccccatatctgataggaccaagaatacccccaggacgtgcaatctaacttttacattcttacatttccaacctcatctattacacaagcaatgaaaagcccatacaaggccctgtaaccacgaatactatcttaactttccaagcccctttatgcatccagcacaacctgttatcaggcttgcccctggggcacctactaccacatcagtgtaattacaccctacaacttcaagccccagctgatcatagtaacttccgagtcacccaaacagctccattcagatggcttgtccacttctcagggccccccaaaatcatcacctcctccctgcttaacaaaaagtccaggttttgtaatggcaaacatactccctgcatgaccattcaccccagaccccctgcagcagcgcccccaccactagtgaatgcctcctcatcccctctttcaatcactctctcgaatggttcctagtggatacaaaatgtttttttctacaatgggaaaatagaacacagggagccacacagtttgctcccaacacccctttccagtcgcccactggagctatcttggcaagtactctaggagtatgggaaaatgaaaacaacaaactcacacacctttttaacatgcataaccagttctgtctacccagccaaggtatattcttcttatgtggaacatcgacctatatctgcctccccactaactggacaggcacctgcaccttagtctttctaagtcccaacattaacattgccccaggaaatcagaccttatcagtactcctcaaagctcaagtccatcagcgcagagccatacaactaatacccctacttatagggtcaggaatggctactgctacaggaacgagaatagctggtttatctacttcattatcctactaccacacactctcaaaggatttctcagacagtttgcaagaaataatgaaatctatccttactttacaatcccgaatagactttctggcagcagtgactctccaaaaccgccgaggcctagacgtcctcactgctgagaaaggaggactctataccttcttagggaagagtgttgtttttacactaaccagtcagggatagtacgagatgccacccagcatttacaggaaaaggcttctgaaatcagacaacgcctttcaaactcttataccaacctctggagttgggcaacttggcttctcccctttctaggtcccgtggcagccatcttgctgttacttgcctttaggccctgtatttttaacctccttgtcaaattttgtttcctctagaatcgaggccatcaagctacagatggtcttacaaatggaaccccaaatgagttcaactaacaacttctactgaccacccctggaccaacctgctggcactttcaccggcctagagagctcctctctggagaacactacaactgcagggccccttcatcacccctaggaagtagctagagtggtcatcggccaaactcccaacagcagttggggtgtcctgtttagaggggggattgagaggtgacaatgtgctagcagcccttgcttgctctcagcacctcctcagcctcggcgtctgcactggccatgcttgaggagcccttcagcccaccactgcactatgggagcccctctctgggctggctgaggccggagccagttccctttgcttgtggggaggcgtggagggagaggcatgggtgggaactggggctgcacgcgttgctcacaggccagcgtgagttccgggtgggcacgggctcagtgggcatgtactcagaacggccggctggcaccgctggccctgggccgtgaggggcttagcacccaggccagcaggtgcagagggtgctccaggtcccccagcactgctggcccacccataccacactcgaattctcaccaggcctcagctgcctccctgcaaggaagggctcgggacctgcagcctgccatgcccgagacccacccccggtggactcccacacagcccaggcctccccaacaggtgctgccccctgctctgtggcaccaggtcccatcgaccgcccaagggctgaggagtgcaggcacacagcacgagactggtgggaagctctgcccacgaccctggcacgcgatctgctaggtgaagccagctgggctcctgagtctagtggggacttgcagaacttttatgtctagctggaggattgtatatgcaccagtcagcactctgggtctagctcagggattgtaaatgcaccaatcagcaccctgtcaaaatggaccaatcagctctctgtaaaatggaccaattagctctctgtaaaatgggccaatcagcaggatgtgggtggggtcagataagggaataaaagcaggccacccgagccagcagtggcaacccgctcgggtccccttccacactgtggaagctttgttctttcgctctttgcaataaatcttgctgctgctcactctttgggtctgcactgcctttatgagctgtaacactcactgcaaaggtctgcagcttcactcctgaggccagcgagacaatgaacccactggaaggaatgaacaattccagatgcaccgcctttaagagctgtaacactcaccacgaaggtctgcagcttcactcctgaagtcagcgagaccaagaacccaccagaaggaagaaactctggacacatctgaacatctgaaggaacaaactccagacacaccatctttaaggattgtaacactcacggtgagggtccgcggcttcattcttgaaatcagcaagaccaagaacccaccaattccagacacagtgatgcaaccacaacattgtcagctggttgcaagaagaatggcagatgttaaggatcacaagattgaatgaaagtggtcatcatttccaaaattgtattctaggtgatgctaataagaataccccaaataggagggggtatatggctatgtggtttgatgatatggggagaagctgggtcaaaaagagttacacaatttttgtcaatgcaggacttctagagtctttcatatgctaaagtgaacctctatgaggagactatgatatgcaacattccctaatcttgtttgaacacaatattcttttttcttaaagatggtaacatttgtagattattcgtttttcatgtaacacagtttgaatgaattactcaatctgcggtgaaaattatcagagtgcattgctgacagaagggtttgcctcgggtgttcacacttacagctagaacagtgtcataaaccagcaaaaccaggttgtcttgttaggcgaattgcaatgtcatccatagcagggctactaaactgaagttcactttactagctgagttgggaaggtaggatgaacagtagacaaatgtgtgtagatatttttatttctgctgttacatggaggaagacaccatcacattcatcagagattgaaataatttcagggtccaaacaagcttaagaaccaactgttccttacacagtaaaaaataatcttgcaaaggtaatattaacactgaattccagaacctgcttttaatttcagacaaatctcagcttctctggagcttggttccctcatctaaattatgaagacgatattctttgtcttatgtaccatgcagagttaatatgaatatgaaattacatgagataaagagatgcttagctccaagtgctatgcaaatattagaattattattgctacagtaacattaaatcatattttctccaacagatgcaatataggaaaggaaaaacatctgtggcatttggagattagtaatgtgtgctttaaaaccacaaactacaaagaaattggaagtcatcaaagaaggagaactaaaatcaaaacaaatctctctgttggaaaagctcaagatgacaagtcatgtaatgaatccatctgactccaggcaggaatcctactgatcttacatacttgtggacaccaacattttcagtgaaaatggcatttcagtgtattagtaatattcctactatacacacacacatacgttaaaaggaaacaaatctagggtagtggtggcactgtaaaaatagcatcaattaatattgtttataattgttaatagctctatggccttataaccacgaaatatcaaccattcacacttcctaagtgcctatattcgagaatataggggttttaaaagttgagtgtttactacataccaggtgtctcatccatggtcacatttaattcagtgagacagaaattattatccttatgttacacatgaggaaactgaggtccagagagatgtgatccagttcacacagcaagtagtcatcagaggtagaatttaatgtctggtctctctgattccaaaacacttttcaacacatctgctgttactccaatttcaaataaataaataaacaaactgtaaagaactgttttcagtgatgtaagatccaatgtaaaagtttaaataactgaaaataaatttacatttaataactgaaaataattttaagtaggaaaatatttctatgatcatcccagaaatgtatttttataattatatacatagaagaaatttcaaaaagaaaattaggtttttttctttagagacagagtctctctctgtctcccaggtggagtgcagtggtgctatcatagctcactgcagcctagaacctggactcaggtgatcctctcatctcagcctcctgagtagctgagactacaggtgagcaccaccacactcggccaagtttttaaaaaattttttgtacagacaggcccttgctatgttgcccaggcttctttgaactcctggcctcaagtgatcctcccacctctgcctcccaaagtgctgggattacaggcatgagtcatcacacccagcctggaaaattacttttaacagaagtaatacttacttagtaagtgacagtataagtggtaaatgaaataaataatataatttaaatagaagaagcacttagtggctaatacttattgattgacaataagtcagcactaaaaagcatgtgttatatttaataaaatgttctctgatcaatattacctatttttatactcatctggaaatagcaagttctgtatgttataactgggctgaggaatgacctagtttctttgcatacttttaagaaacatttttactctcacaagttttgtaaggatacttcacaatcattaatttcaactttgataaccacagcattcaaggaagatatttcccactctttattcatcagcagagaaacaccagcttcaaaaatacctttctctgaatatcaatccatcaccatttcttttttttttttttttgagacagagtctcgctctgtcgccccagctggagtgcagtagcgctatcgcggctcaccgcaagctccgcctcctgggttcacgtcattctcctgtctcagcctcccaagtaactgggactacaagagcccgccaccatgcccgactaatttttttttgtattattagtagagacggggtttcaccatgttagccaggatggtctcgatctcctgaccttgtgatccaccagccttggcctcccaaagtgctgggattacaggcgtgagccactgcacctggccaatccatcacccttttttttttttttgagacggagtcttgctctgtagcccagactggagtgcagtagcgcgatctcggctcactacaagctccacctaccaggttcactccatcctccggcctcagcctcccaagtagctgggactacaggcacccgccaccgcgcccagctaattttcttttattttttaatagattaatagagatggggtttcaccatggtctcgatctcctgacctcatgatccacccgccttggcctcccaaagtgctgggattacaggtgcaggccaccgcgcccggccattcatcaccatttcttaaatgaatgagtaaataagatgagaacccagaccagcattcctgggtaaaagctccaaagttttttcaggagatccctcaaacccattatgtccagaattggtgggttcttggtctcattgacttcaagaatgaaaccgtggaccctcacagtgagtgttgcagtttttaaaggtggtgtgtccagagtttgttccttctgatgttcggatgtgttcggagtttcttccttctggtgggttcctgctctcgctggcttcaggagtgaagctgcagaccttcgcagtgagtgttacagctcataaaggcagtgcagacccgaagagtgagcagcagcaagctgtattgcaaagagcgaagaacaaagcttccacaacacagaaggagacaacagcaggttaccactgctgccttcggcagcctgcttttattcccttatctggccccacccacatcctgctgattggtccattttacagagagcagattggtccattttacagagagctgattggtccgttttgacagggtgctgattggtgcatttacaatccctgagctagacacaaaagttctcctggtccccactagattagctagatatagagtgctgaatggtgtatttacaaaccctgagctagacacagagtgctgattagtgcatttacaaatcttgagctagacacagagtgctgattggtgtactggtgtattcacaatcccttagctagacataaaggttctccaagtccccaccagatcagctagacacagagtgctgattggtgcatttacaaaccttgagctagacacagggtgcagattggtgtgtttacaaaccttgagctatatacagagtgctgattgatgtatttacaatcccttagctagacataaaggttctccaagtccccactagactcaggagcccaggtggcttcacccagtggatcctgcaccggggcgcaggtggagctgcctgccagtcctgagccttgtgcccacaatcctcagcccttgggcggtgatgggactggtgccatggagcagggggcggcaatcattggggaggctagtgcagcgcaggagcccgcggctgcggggaggctgaagtatggcgggctgcaggtcctcctgcccggcagggaggcagctaaggcctggcaagaaattgagccccgcgcgggtgggccggcactgctggggtacccggcgcaccctctgcagctgctggcccaggtgctaagctcctgactgcccagggccagtgtggctggccggccactctgagtgaggggcccgccgagcccacgcccaccgggaactcggctggccccgcaagcaccacgcagacctggttcccacccgcgcctctgcctccacacctccccgcaagctgagggagctggctccggcctcggccagcccagaaaggggctcccacagtgcagcagcaggctgaagggcgcctcaagcacggccacagtgggcgccgaggccgaggaggcacccagagcgagccagggctgcgagggctgccagcacactgtcacctctcaccatgacctgcaacacaaatggaaggagaataccagttaggagttctgcctggtgatcaggggctggagagttcatgtgagtacaaataattattctctccccacaaatccatttcctctgtggaagcgtgagttactttagcccctgaaaagacacagggaagccacatgaaaatgagaaaagcataggaatgtttgtttaaatttatttgtttaattgacaataattgcacatatttatggggtacatagtgatgttatacatataatgtatgtatatgtgatgcatataatgtataggaatcagattaaggttattagcatatccatcatctcaaatagttgtcatttctttgtgttgggaacattcatatgttccttctagctacttgaaactaaataatatattattgttagctatagccatcctactgttatgtcaacaaaagggaaattcctttaatgtcccagccctgagccagtgcaagggcaactcacattagcagctgggatgtccaggaacaggaagtttcagagggccaggttcagacacagtgcccacttcaaagcctgggaaatcaaagatttcccaggcctggtggtctgggcatctctcttttctcttgcagaggtggcaaaactcgacctctgtcctcttagggtcctacctgggcccaagaattaaattgatgtaagacaggttaacgggagaaaagcatacaaatttatttaatacatgttttacaggacataagagcccatatgggaaaagagcccatatagggaaaagaagacccaaggatgcagtgagagtcaatcgcttctatactggttgcacaaaggacagtagttttgaaaaggcagctaaattatgtggggaggtttaaaatagaagaattacttgaacaaggtctatacagaattctctcagttccaatttctcatcattgatagggagaatggtattccttctgtgacagggaggccatctcccatgtgggaatttcatctcctgctgttaagacacagaattaagatcagagtgacctcttcatatctgatgtttttaaaatatctgtaattcaaatagtcaatatgccagagcagcacattttgatggcataattcttaacctcttcactctcttcctcttggagattgcatgtagcctcctaagagtacgaagtttaactctaccataagtaaagtataaaaatggcttcctttcctcactccaagagactccaggcccaaaagataactccagaaagtgaggaactagagcataggccagaacctgcttcttttccatctcccctgcaataatcaaacactctctaaggtacagtcaaagaaagaatgcaaaggatgaaagaatttacagacaggtctgtctgtttgggcttttctcataaaatgtggccatcaaaatgtcataacgggagtcacggccaggcttgacttctaatgatgagaaaagttagataatgcccttctttgtgcttttcacaaaagcagggagatctcttgggagaaaaaggatttatccttctttttcttctttagatatacaaagagacatctggggacagggagtggcccagggaggagttggacatcagaatttagattgcaaaaaggaacactggggagggctgacttggttagtttgctttaattactagcagtcaaagagcaactcacaatggtttgcaccattaggaaaagtgattattacacacaccaaaaaaaatcccaaggaagagggactccagggaagaggcttgtcaattcagtggctaaggatgtcctcatggaccatctttccactttctgctgtgcttcttcagcacatcaccttcatccccatgctatttcctctcaaggtagctgtattagtcggctagaactgcagtaataaagtgccacaactgggtagcttaaataacaaaaatgtattgtctcacagttgtggaggctggaagtccaagattcaggtgtgcacaggattggttccttcttagggctgcgagagagaattcattccatacctctctcccagattctgatgatttgctggcaattgttgacattgtagatgcatcaccacgatctctgccttcatctttacatggtgtagctagtattcaaatttctctttttaataagaataccagtcatactagatcaggaacccactctactccagtatgagctcatcttaacaaattacatttgcaatgactctatttccaaataaggtcacattctgaaatactggggattagaactcaaacatgtcgtttttcggggcgagcggggagggcggcggggaacacaattagaaacaaaacagtagcaaaatggctgctccaggtgtcacacctacaaacaaagtccctagaaagaagaggctgtatcttccttactccttttgagaaacttcacagcacacacagcatcacgtctcaatggtcataactatgtcatatgccaacctctaaccaatcactgttgaaggtgctggtattgcagagatgtggaggtgaaatactccagataatgaaattactaccttgcctgacagacaaagagaaggaacatagtaaagttttaagcatgtgagttaccatgtttccgtaatctttcagtcctctaagttgttagcttttctcctttttcctaatcacatctattagcttttttagaatacatgttcattgaagaaaattggaaagcattaaaaataatatattttgaataattcaaaaatcccaccaagacttcttctaatttcccttctaatttaccggtaagtacgtgtttattgaaaaaaattgagacaatattaacattttacaaagaaccaatttaaaatgattcataatcccatcgagatatcccctactaatgtactagaaaatattttcccatatgtatatgttatatatacatacatacatatataacaaaaagtgtggctatagtgtgcgtaccgctgagtagcctgcctttcttcagttagtattaatttgattgtttgcatttcctttctgcttgtggtaatgttattaatcacaactatctggaacaccttacccccaacacatatttacactctacagttctcttttggtatcattaattgcaaaagagttccagctcaagttaaaccacaggaaaaggctcttggttccagtcatgggaggagagaagaggtctgatcagaaatgaattcgacgttattcattaaacccaagtcaaacagtcaaatgtttcctcctttgtgaagtatttttcactgactcctcctccaacctaaggagaattctcccatttgtgcacaattactattgagctgactgtccatgttctctaacataacactctgatttgtgatatcattggttttccacatgccatgatacccttgagagcagagatgagctctgatctatctttatatctccaggcctagcatcagtagacattgaatatgtgttttattgaacaaatgaattcattcattcattcacagaagaacaagctcagaatttttttccttattctctaccatagttccctacaatggtttatcataatttcaaaaagaggcaaagtttgaacaattaatttttaagtattatttggaagaaagtgaaatataattatttcaacactaacctagatattatgcttacatatcagtgaggcatgtgccttaaaaagccagatgtctgtaaaaatcaaataataacttgacaaccaggtgatggttgctaggaaactgcatttttctgtgaaaacatgatgtatgaagtgtagcctagattcatatcctacattaaacatcttccttggagttatctatgaagtctgattttgcatggcttgtcaaggtatataagttattccctcagttatcctgctcctgctcttaaaaatcatatggttctatacatagaatattatttcaacaccattatttgttctgaactcaaggttgtttaggttatagattgaggccccttttggctccaaaacttttcagtggcatcaaatgttagttaccctctcatagttgtcactgaggaacaaccttcacttttgatgtattaattgtgctaagtgaaaaaaagtaaaatatgtacaatgtttctatgtattccaaagtgaaataaaaataaatagaaattatccatgagttttgaaagatttttgctcaccactactggaacataatagagattttactatactctgcctaggaagttgactcctgacattgatagtgaagttccagaaagtgctgaggaactttgctaaattcaagagctgggaattttgtttgaaataaatatctcaatatttaactgctgtattaattagaaaaattgtattgcaagaaacagaaacccaaatcaaattagttaaagccaaaaaggacatactgagatactagaataacttgggtaacttacaaaattgaaggaactaaagaaaaataactgaaaagtactaaggatgtcaggaactagaaccaaagacaacacaactctctccaatcagtccccatagcttctactgttttctcagcatccatctcattttcccgggtttctccttgtgccaggaacatgaccaccagaagctctggggtcaaatacaagaggcaagagttttggctctccacatccttagaagtttctgtgtaaagattacaattgacccagactgggtgacttgcccagcttgtggcaaatgggtgaggttaagtgcattggttgacaatctccagtaggggttgggagaaaccagtttctaaaaggaagagtgaagcttttacatggacaagggcagaagtcaaggtatgcagaaacaatcaacagaagtgcattactccaaacatatccagcaatgattttaataccactttcaccagttttgtcaccacaaagtgacaggacaacccagctcctaacttatacaatgtcatctttatgactattctaaaatgctttgaactttttcatcttaaaacaccaaaggatcgctatgacagcgcaggtgctttttctcacgtgcatccttctacgaaatgcttagacatgaattctgaggcttacttttcacaaattaaaagattttttcatggaaacacaaaagatacaaaaagtagaaagatccatatgaagcaccttcctccacagtttctaagcttctaaaatcaatgtttcccagttcattaacaagctcgtacataattattagagtaacaccattaaggttagcacatacaatgactcccaaagaaaaaacattgtctatttataagcattgctgtgaatgggtggaacgtctcagcaatacagtcacaagcagcagtcccggtgttctcactcagatattccacgtagcacttcatagtatgctttaagtgagggaatgtgacctatagatacatctacacgagaaggattcccataaggcataaactgttcaataaacaatcataaaaatatattcattcttccctatctagaaatctatgtctttatttaaaaatacgtgatgattcatgcttaaggacgtgttgttggacagttggttacagtcttttatctagtcaaaagattcttatctgccagaaatgtgataagtccacttataactagtctctcaaaacatcctagatatttttctctgtatgcatagttaatcatacaaattaatctaacctaatgccatcttgttaccctaaaatgtttaatgataatggcttatcatctttcatccccataaattttctccttgctttcagtgagcagcaacttcactcccatatacgcacttgttgtgtattccttctcctgccaaattcacacagtcacctcctcttccaggataagacgtttactgctgataatcacagccacaggggaaacaaagaactgccatgctcaaatgagggtaaggtgaggcaggtccattaatttacaaagggactgattacaaacatgcaagtggggtgcagggaaaccacaggtgatgctacatgaacgcagggctgaagacagtagagctgttactacccctaggccaaagggacagagagatagtgggcaccaaaaccaaaggaggggaatctacaggcaggtgctggcccagcaacagttttttagatgaactaggtacggaaattgagaataagcatttataaacttcaacagtaatcccaaagaataattgtgtctaataaaaaatgaggtttatctaataataaaaatggggttggattttctatgtctttttttttttttccaagatggagtcttgctctgttacccatgctagagtgcagtggcattatctcggctcactgcaacctctgcctcccgggttcaattctcctgcctcagcctcctgaataactgggattacaggtgtccgccaccacccccagctaatttatttatttatttttaattgtatttcatttttctagtaatttctttgaattctatctatttacagaagtgccagctattgataaattggaaataaggaaaacaagctgggccttagccacagatattgtaagaagcttttctgtagagaaggccttcttgggcaaaacaggcagcccaaggatacccagtaggaggatagtcaaggaaattgatactctatccttcctctcttcacttcctccagtctcttgtcgaagttctccatttggctatacccactgaggtccatgtgggtcagtctctggaggcaaaaagcaggatacagaagggtggagagtggatccccatcctgtacagttgaaaagtctatgtccccaacattgcaaatgcacgaagtcccatcaccacagagtgatgtcatttagtcacggagtaatgtctccctgtgccacttaccaacttactaacactgaactccaaattcactctaaatacatgctctgtcataatgaacagaattcctttagcacccatcctttacagtgagcatgatattgagctgtctcagtagagggcgctggagggatactgcaacaggaaagggctctcctgctgtttgcagctgctgcaagaggtcagcagtgtgggtgggagggcttttgtcatgctcttccctggctgcatccctgagcatggggttcctttgcaacttctcagctgcagcctggcctagcattaaaaatagaacccattacacaggtttgttgtaagtaagtgttttttgttttttgtttttttttttgagacggagtcttgctttgtcacccaggctggagtgcagtggcgcgatctcggctcactgcaagctccgcctccctgattaacaccattctcctgcctcagcctcccgagtagctgggactacaggtgtgtgtaagtactaatttttaaagggcagatataatcagtatattaacatgcagttctcacaggggtaactaaaaacaacttttaattttattcctcactgtctgcttgggagtgaaggactggctagcccttctcctacccctggatgaaacttggggtggcacaatggctgttctcacacaggactttggagggaatataaaatcctacaattacttcaagacacaaacatagtctcaagtcagttattgaaaatgtccaatccaatgcatcaatcagtaattcaatttgtattcaaaggtaagacttctgggaaggaatccttctcttttatttccttactccccactgttcactaattggcttttggcccttccagggttaagtgctcagatgaaggaaagaaaaggggataaaaaagttcatacttgacagatactgtcaaaatgttgcttaatgctgtctgtctgacagatgcttaagactaacctttcttttatagacacttttgggattcttcagaggggttcctgccaagtgatgtattctagttctccaattgccccacatgacttagtccttggttttccagaagttcactcagtactgaccttcttctattttcaagatagtacccctcttacacaagattttaaattgttccaaaccagaacttacacaccactcggctcacactagaccatgggaatattcgtctaccttttatcccaacaaactctacgactgaaggtcaagctggggtagcaacaactctcctcacttcacctgcaaaagcacttgccagacctcctctgagcctctctacagacaccacccgcagtgtctgtgaggtctgctaatggagcttgccacaaaatacagactgaaacaagttttataaacttcctcagctttttgagagagggaagaatttcccatttgaattcttccaaggagatttccccctgtactcataacttttcatctttatttttctttcctatgacccctaagcaaacatcctgttggtgaccataagcttggcaataaattatccacgtgttgcctcactggggttttactaccagttggtctatactgttgtgggaataacatgcacagtcactgcagaaggaattaagccattgtataaactttaaaacatgcaagcccacccattaaaattgttccttgttattcttaccgtatatatccaaagtaaatgaagttgagatttgatgtcatcagtagcccatttgattatctacaagaatcagataacaaactggtattatgggggagagatataaataggaaatcagtgatgtgctcaaactgtaaatctagccccgccatggcttatttctataccagttgcttagcatggccaacccgaaagtcaacgattttaatagtccctgaatagtattatgatgatctctggttacttagtagggccctacctagcagactgtttctgctttaccacatttggatgtcagatccaacttttcttgcactgactggctgtaataacccatatggggcagggggagaaataagtggttttttaaatttacttttgccagtatgtgttaatagtacttagtttcataattctggatgtggctccagtaatcagaagagctttaaacagaaagatcaaagtccatagaaaagagttttgtttccgtttccttagaatatagatcatcctgtgaaaaacataggatttcttcaaggtaaataaatagtactcacaggaggctaaggcagagaaactataatgacaagtagttcaagtgtgtaaagaaaaatactggttattaggaaagactgctcagatgggccagtataattaaaatagttaaagtgacaagggattgatctgaaacaagtcatgagaatccctacaaaaagcagttccctaaactggctgcataagaaccatctggagtaataagcttacgaattaaactgatacaagcctgtctgtacctgagacagccgatatccagtctgggcttcttttcagtaagagaattctgattttattgctggtaatgtatccagctaaaagcaatgtttctcagcttctcctgaagattggtatggccatgtgactaattctggtcattgaatacaagtggagattattggctattacttctgaaaaggctctttaaagagggaggaagagctgagtttgaactttttgcctttctacccattcctccttctatgtagaatttagaccttaaggctgaatctgtagcaaccatcttagagcatgaagcaatcttgaaggtgggagtcacaagttaaagatggcagagctaatggattaaaggagtctgggttcccagccaccatgggactgccatgccaaccctgcactgctccttccacacttgttttataagaaggaaagtaaacctaacatagataatcctgttactatacaccatcaaatcctaaacacagtgctactggcattttcttagccttaccagattgcaacagatgattttcattttcaggcaagtataactacctccacaatgctacccagctgtcagtgattacagcataccatttggggaaatgcatgtcttagaattaatgaaacaggtatttagagtcttcagtttatccagctgccttagcttgcctgaaatcttactagtaaactcactgattctgggaccatccagaagctggaaattcccaatgtggaagagaaatggccatgagagaatgccttgtgcatacctggcacagaaaggaagctaaggaaaagcaatccaacacagacattgccacccacagttgtatggaaggcaaagtatcagtgagaaagaagctgtagtaacatcagtgttggagaatctttatttattatagggttaacctcttgtaccgtaatggaccttaaatgagcacagaagtctggtctccaaagtgagacctaaaggaagatgatgccaaccagagcatggaggacagactggaagttttcccctggcacaggccatcagtaatcagctgttgatatgcctatgttaattgtctggtaaactcgtggtgctgttttggctcttctcaactagttcactttttaaaaatttaagcacctcattaaagaaacccttttagatgtggtaaagcgaaacagtctactaggtagggccctactaagtaacgagagatcatcataatactattcagagactattaaaatcgtcgactcttgggttggccatgctaagcaactggtatagaaataagccatggcggggttagatttacagtttgagcacatcactgatttcctatttatatctctcccccataataccagatacatggtagtcactcaacaggacaaatattaaataacaaatgacacaatacatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgcttgaacccagaaggcggaggctgcagtgagccgagatagtgccactacactccagcctggtgacaaaccaagactccggctcaagaaagaaaaaaaaaaatcctacagttcaaacatcagccaacttttctcaccagagtgagaattttaggtatacttcgctttctgcacttcatttcttttgctttttcataattttgtttagtttgcagctatgaacttaaaccatttttgcagttggctccaaaaatgctgtgaagacaagtgagagattcattcatttatttactcattcatacattcaacacatatttaccgagcactactgcatgccaggtacatagcaatattagtaatcatcttaataaatactaaagtagatatgaattccaggattccagaggtttctttcccattaaataatcattgggatacctaaaagtgttttgaatatggcaactggccaaagatcccaagagagcaattgaaatacatacatttaaaatggtagtttgaatttaacaattgggagaccacttctgacccttgaaacaagtgaaccgtcccattaatttatccttttagggctcactgaacaatggaattggtgacttacatgttccacactcacagcaggaacattcaaagcacgagtgactgaggaaattgcttccagatttgttcttcctgcaataatgaaactgcctcaattacaaggcactcaagtttcacttccaaatctccctgatatatacatacatacttatatatacatatatatatgtatacatatatacacacgctgaatctctctctccaccttctcttgaagttttcccctctttaaagtcctcttcaaagtttactcattattattctatcaagataaaagacagttttctaaggtttaagccaagaacactctataaaaataatctctaggtttaagaggtggccagtcaagtgaccccaactctgtttccccaagattaatttttccatttttcctcaggttttcttacacttcttactgaagtcactctggcactgatgccaccaacacacatgcactctcacatacatgcacactcacactcatatacacacacactcacatgcatacacatacatacacacacacttacgttcactctcaaaactctttttgaagggaagatgaagaacgcttttcctgaatatacaatttaaaggataaagatgccttgttttatgatgcactgctagggataaaaagattattatgaaacaatatatagagaatgctgctataaataaggataaatctgtgctccaaatgttaacagtgtttatctctgagtggtaaaattatgtgtggttttattttttttcctttctgcttctttatatctgccaaagtttttaacaatgtacttgtatttcagtttcttttaagaaaaataaaattaagtcatgttttgtttgtttaaaatctctttttccaggttcccctaaacaaaaggcaggctggaattcttagagattttactaaagaaaaagaaagaatgttgaaagctacaacaatctttttaaaagaggtttacaacattttctgtctttgtcatagtgatggacaagtttcccagccctaccccattccatattcagcttttcgaggtcttgtcttgaaaagagaaggtgttcttttagactcctaaaagtgtggtgtggtgtcagagcacagacacccaatctagatccttcgcttcccacccctgacatgtcttcagggggcagaggccaccctacttcccatcatctgctagggaatcccatgggcattatcccattttgccaagatcaaaagcctttgtttccttgatgtacaccaagggtttcccactcagtccttctgaggataaagtgtggagggcatgctgcttcttcaactcagggctggggagttgccacaagaaatgagtgcaccttggccgggtgcggtggctcacgcctgtaatcccagcactttgggaggccgaggcgggcagatcacaaggtcaggagatcgagaccatcctggctaacacggtgaaaccccgtctctactaaaactacaaaaaattagccaggcctcgtggcgggcgcctgtagtcccagctactcgggaggctgaggtctgagaatggggtgcacccaggaggcagagcttgcagtgagccgagatcgcgccactgcattccagcctgggcgacagagcaagactccgtctcaaaaaaataaaaaataaaattagcatggaatgggtttattgttatgtttaataaattaaatattttcaagttttcttaacattaatttctataatggtaagtattaatagatataaatcacatatattaaggctctttggtattctcaataatttttaagagtacaagggggtcctgagaccaaaatgtttgagaatctagcagataaaaatgacacaccagcagagagagcccttatgtaccacttcactgaggagctaggagcttctaacctaatcgtatccaatacccttctcatcctggttatcctacaactccacaaggttgtttctactgatgcatcacccatcagcatgtccttcttctgcccaaactgcaacccttgcacacacacataccaaaaaaacaaaaacaaaaaccttcaaaattacacatttctggcctggcatggtggctcacacttgtaatcctagcactttgagacaccaaggcaggaggatcacttaagcccaggagttcaaaaccagcttgaatgacaaaaataattaaaaattagctaagcatgatggtgcacaccagtagtcccagttactcagaaggatgagcaggaggatcgcttgagcccaggaggtcaaggctgcagtgagtcatgatcgtgccactgcaatccagcctgggtgacacagtgagaccctgtctcaaaaaaattgtacacatttatgccgagagtctaaagtcctaacacttaagaacctcacttgcctgtctctaatattccttcccccttcagcatgctgtaaaaggatagatgaatactctatcctaaccagttataatcagccttatattgtaacttcactgtgactttgcatctcccatgacccctgcctagaatatgatacatctcctctcaaactacccaactcctgtctgtcctgcaaggcccatttggaatccatcttcactgcctaatattgctatacccatcccttctccagactccagacatccctgttatctatttgtttagcacttaatgtgtgcttccatgtattattatcttctcatgaaatggatattccttcaataagatcataaaaatctacagagaatggacttcttcctttttatatcttcttcaacccctaataagtccttggacacataagacactcaatttataaacaattgctaattttgtagattaaggaaagaaggtgaatgaaaggagatttcaaactagcacactgtgtttgaatataattctgagaaatataaatcaataacctgggaatcatctaccaagacctctgaggaggcaaatattccagccataagtttttcttctcattctatgaaactttcctagaatcagtttaatgtggccctgatgctacaaataaactaatcctgatatcagtgtttctaagttgccgtaaagaatatagtaatgggctacagagaaaatcccaggctaaatgagaagaaaaaaattcctggaaagttcataaactaaaagtaataaaaactttatttccttctatttagatggcccatgggttaaattttaatgtactattcttttaggttttttatgtgtgtaattggacccatggaaatgcatgaatacctattccatttcctcacctctcagtcattcctcaacccattgtggtctggcttctattcccaccacttccttgaaattattctatacaaggtcactggaacctccctattgctaaatacaatgggtgcttctcaggccttatctctctgtttttttttttttaattcattgtcggcaacaaaaaatggaattgctggtttaccttaaattaaattaaatgatgcatctaggttgatgtctagatcatctgcttaaaccagcagaatagagagttcatgtgtccttttagaggatgatgaggagggaaaggaatattaatttagaaggttatgttggtttaaaattaatcatttaaaaatttatcagttaaaaaggttgaagttatttatcaagtatttcattcattcaacaaatatttcttgaatatcgcctaaatgtcagacattatgctagttatgggcatagcggaggctttccaggtaaacccagtcctttgcctcatggaccatacagactattgcagagtccatattaaggcatatataactgcaggggccgggcacggtggctcacgcctgtaatcccagcactttgggagaccaaggtgggaggatcacgaggtcaggagatcgagaccatcctggttaacacggtgaaaccccgtctctactaaaaaaatacaaaaaaattagctgggcttggtggtgggcgcctgtagtcccagctactcgggaggctgaggcaggagaatggtgtgaacccgggaggcggagcttgcagtgagccaagactgcaccactgcactccagcttgggtgacagagagagactgaatctcaaaaaaaaaaaaaaaagacatatataactgtagcatagtctggtaagtgtggaggtaggctccatgaatttggagaagacagaggtattagccaactctgaagtaatgggactgtcaaagccttcctggagaaagcagcactgaaggtgaaatgtgaaggaaaaagtagaaataaggctggagaaatatgggagtgggggcagatgcttctgccgtaaataccaggcaaatagtttagagtttattttcacaataatgggaagtcatgtgaggatagtgacatgctcagatttgcatattaaagattcaagttggctgggcacagtggctcatgcctgtattctcagcactttgggaggccacggcaggcggatcacctgatgtcaagagttcaagaccagcctgaccaatatggtgaaaccctgtctctactaaaaatacaaaaattagctgggcatggtggtgggcgcctgtagtcccagctatttcggaagctgagacaggagaattgcttgaacctggaagatggaggttgcagtgagctgagatagtgccactgcaatccagcctgggggagagagcaagaatctgtctcaaaaaaaaaaaaaaaaaaagattcaagtctgtgaactcagctctggaccaagctgagttaatagacatttacagaactctccaccccaaatcaacagaatatacattcttctcagcaccacatcgcacttattctaaaattgaccacataattggaagtaaaacactcctcagtaaatgcaaaagaatggtaatcataacaaactgtctctcccagctcagtgcaatcaaattagaactcaggattaagatactcactcaaaaccacacaactacatggaaactgaacaacctgctcctgactgattactgggtaataacgaaattaacgcagaaataagtaatttctttaagaacaaagacacaacataccagaatctctgggacacagctaaagcagtgtttagaaggaaatttatagcattaagtatccacaggagaaagcgaaaaagatctaaaatcaacaccataacatcacaattaaaagaactagagaagcaagagcaaacaaattcaaaagctggcagaagacaagaaataactaagatcagagcagaactgaaggagacagaggcacaaaaaaacccttcaaaaaatctctgaatccaggagctggtttttttgaaaagattaacaaaatagatagattgttagctagacaaataaagaagaaaagagagaagaatcaaaaggacatattaaaaatgataaaggggaaattaccacttatcccacagaaattcaaactaccatcagagaatactataaacacctcaacgcaaataaacttgaaaataaagaagaaataggtaaattcctggacacatacaccctcccaggactaaaccaggaagaagtttaatccctgaatagaccaataacaagttctgaaatggaggcagtaattaatagcctaccaatcaaaaaaagtccaggactggatggattcacagctctgtatcggtattcacggatacagaggagctggtaccattccttctgatactatcccaaacagtagaaaaagagagactcttccctaactcattttacgaggtcagcatcatcctgataccaaaacctggcaaagacataacagaaaaagaaaatttcaggtcaatatccctgatgaacatggatgcaaaactcctcaataaaatactggcaaaccaattccagcagcacatcaaaaagcttatccattatgatcaagtcagtttcatccctggaatgcagtgctggttcaacatatgcaaatcaataaacgtaatccatcacataaacagaaccaatgacaaaaaccacatgattatctcaatagatgcagaaaaggcttttgataagattcaacaccacttcatgctaaaaacgctcaataaactacgtattgatgggatgtatctcaaaataataagagctgcttatgacaagcccacagccaatatcatactgaatgggcaaaagctggaagcagtccctttgaaaaccagcacaagacaaggatgccctctattaccactcctattcaacatagtactggaagttctggccagggcaatcaggcaagagaaagaaatgaagggtattcaaacaggaaaagaagcagtcaaattgtctcgtttgcagatgacatgattgtatatttagaaaaccccatcgtctcagcccaaaatctccttaggctgataagcaactcagcagtctcaggatacagaattgatgtgctaaaatcacaagcattcctatacaccaataacagatgagagccaaatcgtgagtgaactcccattcacaattgctacaaagagaataaaatacctaggaatacagcttaaaagggatgtgaaggacctcttctaggagaactacaaaccactgctcaacaaaataagagaggacacaaacaaatgaaaaacattccatgttcatggataggaagaatcaatatcatgaaaacggccatactgcccaacgtaatttatagattcaatgctatccccatcaagctgccatttactttcttcacagaattggaaaaaactactttaaatttcatatggaaccaaacaagagcccataaagccaagacaaacctaaggaaaaagaacaaagctggaggcatcacgctacctgacttcaaactatagtacaaggctacagtaacaaaaacagcatagtactggtaccacaacagatatatagaccaatggaacagaacagaggcctcagaaataacgccagacatctacaaccatctgatctttgacaaacctcacaaaaacaagcaatggggaaagaatttcctatttaataaatggtgttgggaaaactgactagccctatgtagaaaactgaaactggatcccttccttacaccttatacaaaaattaactgaaaataaattgaagatttgaacataagacctaaaaccataaaaaccctagaagaaaacctaggcaataccattcaggacatagacatgggcaaagacttcatgactaaaacaccaaaagcaatggcaacaaaagccaaaattgacaaatgggatctaattaaactaaagagcttctgcacagcaaaagaagctatcatcaaagtgaacaggcaacctacagaatgggtgaaaatttcgtaatctatccatctgacaaagggctaatatccagaatctataaggaactgaaacaaatttacaagaacaaaaacaaacaaccccaccaaaaactgggcaaaggataagaacacttttcaaaagaagacatttatttggccaagaaacatatgaaaaaaagctcatcatccactgattgttagagaaatgcaaatcaaaaccacactgatataccatctcatgccagttagaatggcgatcagtaaaaggtcagggaacaacagatgctggagaggatgtggagaaatgggaaagcttttacactgttggtgggagtataaattagttcaaccattgggaaagacagtgtggcaattcctcaaggatctagaaccagaaataccaattgatggtttgcagtcccattactgggtatatacccaaaggattataaatcactctactttaaagacacatgaacacatatgtttattgcagcactttcacagtagcaaagacttggaaccaacccaaatgcccatcaatgatggattgtataaagaaaatgtggcacatatacaccatggaataccatgcagccataaaaaaaggatgagttcatgtcatttttagagacatggatgaagctggaaaccatcatcctcagcaaactaacacagcaacagaaaaccaaacaccgcatgttctcactcataagtgggaattgaacaatgagaacacatggacacagggaggggaacatcacacactggggtctgtcaggggctgcggggctaggggaggtatagcattaggagaaatacctaatgtagataatggctgatgggtgcagtaaaccaccatgtcacgcgtatacctaagtaacaaacctgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtgtgacatcaaaataaaacaggctcgagatggaaacctgaggagcactaatatttaaagaatgagcaaaggaaatcaaaattgaaaagcagcagccagagaagtaagaaaaacatggcacaaacagctgcaagcaaggaaagaatgtgtttcaggtaggatgtaatcaacaccaacaaaattatcagagcggtgaggcctgagaagcacccactgaacctaacaataaggtggttccatgtgacttggtataaatttcagggaagtggtggggacagaaaaaagccagaaccaatggtttgaatagtgactgagaggtgagaaaacagaacaggcattcgcacctttctatggtccagttatacacagtaaatgaaacacaaagatcatggaatattcaggttagtcagagcaccgtggccttgctaatacagcatctgattaaagttagcccaaggaaaaagaactgaggattcaaaattggaatgtctggtctcccagaaaaatctggggactttgtctaacttttaccaaatgacttattcgtatctcagtttctgggggaactgatatgtcccaattttctcacaatattgtttcgagtatcaaatgttaattgtcaggaaataactttgcaaggttaaaaactagtttgtagaggaagtaataatgagttttagggccggccctgattattgcaagtacaactttaacaaggggaagaaaagacattttttccctcttttcactcaaacaagaggggaacatcagcagagaacatatgccagcttcaaataaatgattgtacagttcccagtggcttcaagaaaatggcattagttctaccttgacattcaggcacttggatgacacaagaggcacttggctttttggaaaataagtccttctgtgggatgatactcttcagcatgagaggcaatagtggaaagtgcatcggttatagaatccagtcaccctggaatggaatatgtgctctgccaatatgagtcatctgatttaaagtgagttacttaacctacctaaggttgagtttcctcaagggaataacaagagtgtttactccatgggatcaggaggtttaacagaatggtgtataaagaagaactgagcaggatgcctggaacacaagaagtgctccgtaattgttagtaaatattcttactaggacaggacctgtttcctctgccacagtaaaggccctacccacaacatttacttaaacagcgttcatcccaagactagagacagagccagtgtctagctgttcatgctaatgtgtaggtgaagtaaccgaataatatacttacgttctggggaactctgctcctgaagaaaactgtagagcattatgatttaacattcaaactctattacctggtaccatcatagcatgcatctcttaacataagggactgcatgttttatagaacatatgatgaatatttatataaagcaggaacttttgccaagctcagaatcggtgtactgattttactgttcgctgaagttcgggctaactttctgtttccctgtcgctgaagagatacatctctcacttcttccagttagactaaaataatgctcattctcttatctgttttctatccaacagggttcagctaaatgcagagggtcctggattcttcggcttgcaaaacccatatagaggtccatacagatttagaagtagatctcaatttaaaaccgcaattctatccatttctggaagtattatatggttccccaaacattcacatttcagtggtgatgccaatctggggcaaaaataataaaataaagccaacttctaaatgtagcatcagaagtcctctggaagggaggtaataatttcaatgcacattgaagtactcaaattattttattagtctctactcctaaggtttacattttcaagaatttactaccagtgtttggagaaagggaagtggaggtaaactgtaaaagcctctctgaaggtgagtcaccatggaaaccaagactgaaatcaaaggcactggactgacttatttctcactgatcttttttttcattaattcttgctgtcttttcatggctgtgctttcttcttttagttgacagacgcttgggtgttcagatcatcaatggaagacaattttgttaaggataatgtagctatatcgagtaacatactattatgatgataataactatgcattgagcacataatttgagccaggcccaatgctaagtattttacatacattgtcttttgtattacgtattattggaagcaatataggtaatggaaaaaagtcttatatctttattgagttggcacgtataacatactgaatatataagtgcccgaaatatgttaaatgctcaataaatgttaatattgttcttattttctagtccaaaaaactgtcctatgagtaaggctctttttttctcaatttacggatgtgaaaactaaggattacaaaaagagggtaagtcacttggctgtgatttcccaggtggtaaacaagagaattagaatttcagcgcaagcttgcctgactccagaagccagattgtaaaccattatgctgtattctctaagatagttagaggtctaagaagctcaccaaataaattggttacaattatggtttattttttaattaggttcaaagaactaaagacttagaggcattatcaatgctcacttgatttttttctctagctattcaattagttatttaaagaaaaaaagtcaaggtgttaaatatttggccttggagggcataatgctacatttcaggttcacctttaatctagactcaacagatttttgtttttattctccttaaacttcaggccaggaaaaacaacagagtatctttagaaagagacggaagccaaattaaacaaggctccattctgaatgttttctatgctcccaaatcctatcaacacaaaggtaattcgatgaaaggttcatttctttataaaataaatctcaaggctactgaaacagacaattgggaataatttgagaataaattaattagttttgattacaaacaggaatctactgttatataaagttggaaatgggaaaattctgaaaattacctagttttttagatagcctagagtttagtaacattctttttttaaaataaattgcattgtaaatgaccctaatactagctgtttgcacttagtaatgtgtacatcccttgaggaaacaccacttggaatacaagtaacttgcaaacccattaccagccacattaaattgccttcattagatgttgcttttcttttcctgaggatcactgatccttctcaacttcaggccttattttccatttctatttatattcctatttttctcccccaatccctactaccaccaaaaggaattcacttttctcaaaaaaaaaaaaaaagaatcaaaagtatattaaatttaaagaaaacacctttaaacaattattatggttgaaaagtaataggtttttatgactagaaagcagaaaactaagtccctgcccctcaatatatcccaagataagaataaatcatggaaagcataacagctgcaaatctcccacccagatgagagaacaaccctagggaacatccctagagagaaagatctatcccaattatggaaagttcacctgataactgtgtgagaaagctcaaactgcctcctagcagcactgtcttacctatagttaagagtcagtgattctgttgaagtacttggctcggctcacctactcttccctccttgcttcaactcattccccaacacctatgcacaaaccactttctccagtgttgtgcagttaagaatgcaattgcttcagaggcatcataagggaagatttccattctaaaccgccagaagagacagtggattcattggccgaaaacttctagcataaaagtgagaaatgaactgaaaggtttcatactagacatgcctgaagtctatccatagaagaaagtactattgttgctcaaaatatagtcccttaaaaaaattcattatatatgaaacaataaaagaaaatttcatcctctaaaaaagaattcatgtaattcacatgaaaattcatcacatttggtataagcaagagttcaatcaataaattttttaaaaaccaaaccagataagccaaattgactgagttataacttttccatgaggcatttccaaccccaaaaaatccctcacctttctaaactagtagcagatgttttctagtatccatgtgacaatcatatatggccttgtgatatgttttacaatgtctgctttcgtgattactgcagctttgccttccatagtcacttttcacagtttccatcttatttctttttttttttttttttcgagacggagtcttactttgtcacccaggctggagtgcagtggcgccatctcggctcactgcaagctctgcctcccgggttcacgccattctcctgcctcagcctcctgagtagctgggactacaggcacccaccactactcccggctaattttttgtatttttagtagagatggggtttcaccatgttaaccaggatggtctcgatctcctgaccttgtgatctgcccccctcagcctcccaaagtgctgggattacaggcgttagccaccgcgcccagcctccatcttatttcttaattataaggtctctgaggacaaagacaagtcatcatcatcgtagcctccacagctctagtaccatttccttaatgtgactaagcaatgtaaccagataggcagtcgatgactagtaacttctccctgtagttcaaaatctaaggtcatggttgctctagctagagaaagtatggttttctagattgtaattcaaaaaatgcactatagcatagtgtgtaagactgcctgaggttctaccacttacttcgtgacgttggtccagttacttaacctctctgtgccacatttttcttacacataaaatgaagataataatgggacctttatcatagagttggtatgagtatgaaacatgataatacaaataaattggttaagggagtaatgccacacagtaaaagattaataaatcctagctataattattacattacatataaaagggttcatatgactcctagaatagtgggtaaagatgtgattttgggagttagatatgaaaggaatgaaaagcattttcctaatggatcccaatcacacctggcatcaaggcaaactaagctcttgacatcacagtcaaatgaattacgaatgtccctcattttcccaaagccttgaaatacaatcaacacactgtacacaatcaacttatgtgagagtgatctaatagatcagaatggggccattgtcttggaggattcttaacaagagacctaggtaacctcaccctctgtcctgcccttccagtttctcacctgaacaagcaggttagaaggcattcctagaaggtttacccccaccatttctcagcacataaaggggaaaaaaaaaaaagaacaaatgttctttatctcttctgtccatagtcagtgcttcccagaaacaccctcatctaacccatcattacccccaccccaggaaaaagtgcagtagatgacaacaggcaatgcaaaaaacatgtttgcagtatccacacacatacatacactcctttttgctacataccactagcctggccatccattaatatgagcccggagttattctttctccttctggcatcacagggtcagaagataatgaaggaagagatctagcaatacttaaataaataatgattacaggcaaaatattgaaatagaaaaggcttatctttggggccttttgcatactcttcagccatgcctgctcttcttgaagtctctgaaggcagagcctttatattaccttctgagtttctccaaattcaagtggtccttacatctcatgaaatccactgcagatggctccttagctcccaccttgacccactccaatacattccacactctcatgtcagattaatgttctgaaaacacaggtcttatctcacattggtttttaaacacatttattcctagtgttccattattgaaacactaagcatgtgggagttatttatatcccactgctcaaggtcattgccaaggtctgattgcaaaaattcaaaaaattgcaacctcaggcataaatgggttagttccttaatcaggcatatcactgtttcgtgcattataattatatgtgcatatgtcatgtctcctccaatagactgtaaagtcatgtgaggactcaaattatcaaactcatcttaaaccatcttcacccatctattcaaaaaaattataatgaatacatgttataaaccaggcactacactagtctctagagagaggagtcagaccatgcccttcaacttgttaaaaatcttttggagggtagagagaggcagcaggggttatagccacataagcagaaaactgtaatacatataaaataatttacatgttataatataattgcaatatataatatgttataattgcacaagcaccaagaaatacaggattgcattgaagggacttcgactacactcttgagaagatcaagaaaggcttctcagaagaagtaatgtctaaactgataccagagcataatcaggtatttctagagaaccaggcagtgtaaatggtccattaagattggaactgtgacaaaggatacggtttaagaaacatacagggaccaaatcagaaaaggactttgaagccactctaagtgtttgtagtttatctaaaagtcactgaattgtttaacaggatgaatgatatgatcagatttgtatttttaaataaccattcaaattagagtgcagcagtcatttaaaatgtctgctgaacacaggaatagaagtgacatcagcatggtaaaaaatatttcaggaattcagaaaatagagaaatcagtaaatcagtgctggctgtgataccccagaaaggttttatggtgaagtttaactgggcttaagagagtagattttcacagggcaattcaaggaaaagaagaacatttcagtcaaaggcaggaaaggtccaaggaagataatgagttaagaagtggttgagcaaaagcttatgggaatccatagagcagtgagtagtttagtttagtgggtgctaggtctggagaggtaggttgacacaggaggatcaggccttaaatgctaggctcaagatttagagtttgccagctgagacagttcatggaggctttttgaaagagtgttgctttgagaagactgaatatgaactgaaaaaggttaaaaacagaacttggttaccagtagaaatgtgagaagaaaaaaactatgtgcactacaggagatgggctgcaagatatatatcaaaaaatatatatcagaagaagaaattctgaatggaggcatttccagcagctcagtgtgataatttagaaaataggatcttccttttatcaggctgtttaaccactatctacacataagaacttgaaaatacagtgtttgaaagaggaaatgaggaaaaggaacatttgaagaatgagaaaggaacagctgaacaaacaaaaggcagcactgaggccattcttaaatgtcctagattaataacccaggggtatccagatatttggggcttccctgtgtattctaggaactcccctcaatagatcagacctttatccagaaatgagggccccagagacctatttggctaaaagggctccctcttctttgttgttttggtcactgcttctacctaactcttcgcactgtcagtagctataagaagcaaaactattggctcaattgttctactgtctacagtttgaactctgacctctttgatatcccaaagcaacaagctaatttagtagtccttacttaaggatacgaagaaaaatatttagaaaaccttccaaaattgtctaacaaatctccagagttcattagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtgggctcaagtccatcacttaccagcaaatcaatggattcttttagattggtatttcatttgtcatcatttaaccaatgattattgtcatcattaggactttttagaacatcaggcaaggtaccgtggctcatgcctgtaatcccagcactttgggagaccgaggccggcggatcacctgaggtcgggagtttgagaccagactgaccaacagggagaaacctcatctctactaaaaatacaaattagcccggtgtggtggcacacgcctgtaatcccagctacctggaaggctgaggcaggagaattgcttgaacccagagggggaggttgtggtgaactgagatcgtgccattgcactccagcctgagcaacaagagtaaaactcagtctcaaaaaaaaagcaagaacatcaaagagatgtttgttaggcttattaagtggtaaattttccttggcttccttttctttccaaggtaattatgggcttcttcctgtctctttttgatgcccacagaggccataatgagggcagttaaatatgcaaacatgagaatgagaaaacaggtgtcaagatacatataattttacctattgagacatcctgcctgctaataaacagagaatcgtattactggtacacttaaccaattttcctaaataatttaggcatgttttccaatgtctttgcaaaggtgatgtggggaggtcttttgcccctttaaaattcatcaacacctccagacactgcaagataaggaggtcatgcaagtcaaaacaatgtgtgggctacagatatgcagcttcaagtcaatcctctaaacttctttccaagcacgtgaccatacctacctggaaatactggagtcagctcagttgtttcccctatttgataagaaaagaatgcaactagccagcaaacactttattttcttaaatattagcataatttgtgggcatttccatttttccaacacatcatttctcagatattaccccagataaaataccatgcccagaactggaattatagacaatttactaaagaacatgcataaggggaccacaaaacccttctagatcaaagagagaccacctctgacatgccatggcatcagaaagttctacttttcttaagagccatatactttaattgtggtaagatatttctaacaaaaagatcaatctacgtataatgttattaacatggaatttatttgattacagtttccctaactgtaatctaaagtcatattcattaggaaacgccaaatttccaagagcagagtataatatgcagcatttcccaaacatcttggaccccaaaaacttcttgtaacaaactaacatcgtccaaaaatgacaaacgatatggaaaataccgtattctaccctccaatatcagctgtcagtgggacaggagtaaaggaaaacaagtcaaagcactgagttaactgagttttaaaagacggagagcagttttggaaggatgcagaaactacactttgtctacttaacaattttaagaactacccaatcacagagtatttattatagaaataattaggaataatttgattttatgtttacaaagaggtatgatgtttaactgctcctacgtagtttgaagcttgttcttaaacccaaggtattgccaaatgcctagtagtaccctgtttattactgaaaaaatttttttaatcattttggataaatactagaatcaaatatttgacctgacatatgacaaggaactaacaatataagcctagtctaccaccatctggatgaccaaattagaatcttagtctcaaggccgcccctgtttcagccctgaatgcctcatgtaatgtacacaggagccagaactacattatatctcgttttcaaatagcactggttacgcaccgggcaactgttaaccagggtggcatgtgataatcttccttgctaaccttgtaggaagtgtgcgagccgttatctttctggcaagatttaagtaactcattcctatctaaaaagcatctgttaaagtggcgtcacaccctcaactacttcataaagttttctataaaatgttaaaatcaccagagtcggacctctcagttcatcaggcgtaaaactgcagtttccggctgccaaatcccttaacaacgttaaccttttaatccttcagcctcgtctagtgaaaagcaagtgtcaccagataccgccttctacttgagaaatataacaagattctttctcctgcacttttcccaaataaaaacggctcatatacaaagtgaagtctagggacacccacagtacggagggctgcccggacctggcggccttacctggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctgagataaagaggacaaagggggacagagataaaggccaccagggcaccagccggcaggctccagaaacgctgcgtggcagtagccctcaaacgcccggccgggcatggggccagacgccccggatccgggtttgcaaacgccccaggatttgcgtacatatgctcctcccggatataaagccccaaaccacgccacttcttaggaaaaactaaaaccacactaactgtagaactccacctcctcttcctgtctttctgctttattctctccgccgcaaacttagaagtgagacgtgcagtccccaaggagctgcagaaaagggctcttccggagtcctggggattgcgcgtttaaaggggaccctccctctccccggatcttctctgagcttggcaagttaatcggaagcactcgctggcctctcacctctcctatctgtttgtttgtctgtctctgcgtctttctctctgcgtgtcaacgtaagactcggtctctggatctctctctctttctgtctcccgcccccacaacctctgtatctctgacaggtccgcggtgaaactccgcgatccgctccggcgctctttacaaataaggggaggagggccctgtccccgcctccgtagcacgtggtgacccatttccccagcctgaactcccgcgcgcgtccacgccggggcgcaggaccgccggccttccctccgcgggcgctgctcattcccagcatcagccatgccctcttccccaccctcactcctgagggttacctgatgccacctccgtgtcggggtccctaactcctctctggtctcggggacgcatgcatcttttcgtgatcttgatgaaaccaacttgctgaaatggagcctggagacccttgcattgtctacataattaacaggaattgcttttttttctcacttcttaaaatcagaggagaaagaggaaatccaatggtagcggtggcgggctagctgagccagcactgcccaagccggcccttcctggcgggatatccgcagatcagaggaatgtttatttgttcatatgggagctcaagaaaagctgacttaggtgtgatgtcaacaggtttgtgtaaagtgagtgtggtgtttgaggcaaagtttgtatctggtggatatagtggttcaagtgtaaagtgaaaccatgcttcactgttagatggctgtgaaaggaaaataaatcttgagacttcaaaatcaccaagctaaagggaaacatcaagaagggaccagcttagggcaaacctgcctgccattctattcaaattcatccctctgaggctcacctgagacaaatgcatatctgattgctttctcttctccatcgtttatgcaaaaaatgcagattcactgggccagactaaactgtctattgagtggaaggctgatcatggcctcaaaagaatgcaaccttttgtctcttgtctattatacttctaacctggaagcccccacttccaattgtctcaccttactggactgaaccaatgtacatcttacacatattgattgatgtctcatgtctctctaaaatatataaaagcaaactgtacccccgaccaccttgggcacatgtctcaggacttcctgaggctgtgtcaggggcacatccttaaccttgccaaaataaactttctaaattgactgagacctgtctcagacattttgcattcacgtgactaaggacaataaaaagaatacaagatgccgttcttgcctttcatcaggagaatgcacagcctcctaaaatagcacattttaaagagacattaagtctagacaaaggggaaaagatggggaaagggaaaaaatcttaatcttagaagaggaacctaaagacataactgcagaagaaagagacaggtagagaacattcccagaggctaaggatctaggcagacgaagctgaaggattgtcatatggaagaaggtttaactatattatatctaacttcagaggacagaaggcagcagtcatggggcaaagtcacccagaggaaggtttctgtggaattataaggcatggctgccttggaagatagtgatttctccatgatcaaaagtgattcaaatcaacagatcctgggtgaccgcctttagtaggtggtaggaggattcatgcctgaagggagatgaactaaatgatcttaatactgtgctctttccaattataaaatctacgtatttgttaataataatttacagaattatgttgatgctaaaagggcaaatatttcatctaagggccagaagtaagttaatatcacagttgtcctcttaaatcactcagctcgtgggactcttcaagcctttcattggattttaaaatatagtttgttgcctatttttcctttggacctccgtgatgcaaaatgatttttggaaattaatgaatgctctaaatggctaatctatacccagcaagttgtttatttccagcttttctaaaactaaatttgtccataaagtgttagattttaacaaatataaaaggtttttaaaaatacaaatcttggctgggcactgtggctcacgcctgtaatctcagcactttgggagaataaggtgggcagatagcttgagatcaggagttcagaccaacctggccaacatgtaaaaaccctgtgtctactaaaagtacaaaaattagccaggcatggtggcgcacgcttgtaatccttgctactcgggaggctgaggcatgaaaatcgcttgaacctaggagacagaggttgcagtgagccaagatcaggacactgcactccaacctgggtgacagagtgagactctgcctcaaaaaagaaaataatacaaatacaaatacaaatcttacattgtgggatttttagaatatataatttatctatttatcagtcattcatgtctatgcacatacatttcgccagcccatcaagtccacaaaataagaaacagtaaaataaatgaccaacctgcatgccaactttactaagcccagttaacataatgcaattaagagaaagtgttcagaaaatttcaggttactaactaccaaataggtaaggctaatttctagatcatccagtctaataaactataatcaccaaagaactacaggttaggcatctctaattcaaaaattccaaatccaaaatactgcaaaatatgaaactttttgagtgctgaaatgacaccaatggaaaattctacacctgacctcatttgacaggtgcacaaaattattggaaatattatatagaattactttcagcctatgtttatagggtgtatatgaaacataaatgaattttgtgtttagacttgggtcccatccccaaaatatctcattttatatatatgtaaatattcagaaatctttaataatccaaatttgaaacacttctggtcccaagcatttcaaatcaactcataaccaaataatgtttcatttatttatttatttattttttaagaggcaggatctcactatgttgctcaagctaggacgcagtggctattcacaggcacaatccaactattgaccaccacggagttttgacctactccattcagacctgagccagttcacacctcctcagacaacctggtggtccccagtcaccaccaccccacatctgaaggtcatcatattgatgccaaacttagtgactggcacagcccactacatcccagagctcctgggctcgagtgatcctcccacctcagcctcctcaacagctgggattacaggcctgtgccactgcacctagccagataaattttagggtccaaattctataagtcatattattacaaaagaaaaacacttcccatttaaaatataatgtataatgtataaaatatatttttcttagaaatttgccttaaaggtcgaatacttttaaatgataatgagggtagcatgccaagtacactggccaggatgttgaaaaatgtcacgtttctgactcaggcacttgggaaacctgggaaactcatttgacctcaccaggatgaattcccttgtctgtaaaacaagataattgggacagaagaatatcaagtctccattccagcctttttatttctaagtgtctaatttggaagtcacttatcagaacaaaacatgaaacccctaaaaaagaaataagacttcacttccccaagtgaaaggacagttaacttcaaatcttactttctctaatgatttcagttttttctcagttcagatcttttgtgactatcgcaaatataaagcaaactggcctcttgtaaacattttcatgcatgcattttctctgtggaaggactaataaggaaatctaaaagatgacacacccctttctcttcttcccttctcttccttgccatccagcctggaagtcgttaggtggagtatagcagtgtctgtgtggaggggagccatagtggcccaaagaggggtgttggagcttgaacaagaaaaaaaggatatctaagtaggagagaacatagcatggacagtaggagcccaagcagggtcctgaaggtgtccagatttgggaagagacatgggaaatcagagctgcatcactaatgggataagggtgtatgtgtgtgcacaagcactgactatcaaacccaagtatgatcagcagagcatccttcccagcatgatctgtcagagcccaagctggaagagtagggtgcccaccaaagtagtggccaggtgttgggtgccagagactgagcacagctaggaagcatccatggatctaggggagagagaaagagtcagccagtgtggagagtcagagcctgagaaggtgatgaaggcagtcaggcctgaggtggtcataacagaatgtcagagatgggcaagggggaggaaggtgaccctgaagagcagtagcatgaggtatcggagtctgtgcagtgaggatggcagcctggcacggtgtgtcagaacccaaagaggataaggaaggaatcagtggggaagaggatggcagcagaaatacattagttatacataaggggattcattaaataagtaaatatattagattataatagccagttttctcgttatcacagaagggagttgcaaatatggagagggagaaaactagaatgaacgaaccctctggtcttaggttggaattggagagatcagtatcaattcatggtttgcggtgtagaaacagatatatatatatatatatatatatatatatatatagagagagagagagagagagagagagagagagagagagagagagagagagagagagttatgaataattaccagctctgtccactgacagggtctgagaacaatgacactaatagcaaagagcataactagggcactgagcttggcttctaaatattactatcctctactaaacagaaccagagccccttagaaaaagggctgattccagaagcagacaaagaacaggatgaacctggaatatcaccttgtgcttgaaagcaagggaatggtccaaaaatgcagaaatgcatgttacattattccaggataacatgagattagcaacttactctaaaatggatcagaaggaataaaagtatttttactgtgctggccacttttctgtaagtacctcataattttaaaatttaaacattgaatactaatgaggaaaggagaacgttcctgcaacaaattacattaaaattaaatctaaaattttacaaaaagtataattttctgtgaaattaatttactcactaatacatatttttagcgtttgcatcacagtccattgtgtctggaatacaagaatgagaagatactccttcttttactcttaagtagcttgtagttacaggttggaggaaggtgaaagatggttgctgtaatgaagacttttaaatgttgcggtggagatagataggagcactagtgtctgcagatgatagtgagcacatagtttacagagtaggtaatccctgagctttaaggataagtagaagtttgacagaaagacaaaaaaaaatggaagaacattccaagacaagaaaatgcaaaataaaatgcttgagaggcctgagagaataaagagaactgcaaggggtttcttggaattggagaatctggaatagaaaggcagcatctggcagaatcaggaaaagtctcaaagttccaagtctttgtctaatgatgtccccaaagattccttatgatcatctgaggcaacaacaacaaaatctcttcagtgaatttaaacctctttatcctgtattatcagtatcaatatttagtcctcattattacaaataagccatacctaaaatgctcaaataagaccaagataatgattctatctggaccatctatgtctattcagccatccataccagagacagtagaggtaggaatcagatttctgcaaggcccctcttaacttaattcctaatctctaaaatggggattaaaataatacctgctcaatttacctcactgaataattgtgaaaatcagatgtgataaagtatgtgaaatctctttatcaactctaaagcagaatgcaggtgttaatatatgctggaatggtagggtaacgtgacccgtgtaataggcctagcaaagggccaatgggaaatggacaagaacaaccaagaatatctcaggacaaagactactttataccttacaaaactcaggttttttcctaggaaattgaagtgctaatcggaaatggaaagatccataaattacaccaagtctaatcttgtcatttaggggataaggaaaagaatgctcaggagagttaagcagtatggccaagtaacatatttagaccggaacagaagcccaaacttgtctttttccatttcaccacgacaaaataaacaccagtcaatgtttcaaggataacacccttatgacttcaatgtgattgagaaagtgaaattggaaattatactaacctatgttcttcctagttcttcttcttcatcccttttcttcaattattttctaatgaaccagtgtccccaccctttatgctgctgtttcacctgagctcacccagcattatctcagcatggtttttatgctttataattctacaaattttaaaattattattagaatgttgggaaattttatatatactaacatggaaatatactgagtaaattaattaaaaaaaatgaggcagaacacgttttaaaacaatgaaacagctgcgcacatgcgtgtttgtgtgtacattaacaaagttctgaggaatatgtgccaagttgtttacaatgttttccttttaagaagtaaatgtaagaagtaggtctgaggacaggtgattcaaagggggaagaacaatacctttctctgtggagaaaaatgtgttgttttcctttatatcctcctttttttttttgagacagagtctcactctgtcgcccaggctggagtgcagtgggcacgatctcggctcactgtgacctccgcctcccaggttcaagcaatcctcctgcctcagcctcccaagtagctgggactacaggcgtatgccactatgcccagctaatttttgtatttttagtggagacggggtttcaccatgttggctaggctggtcttgaacccctgacttcaggtgatccacccgcctcagcctcccaaagtgttgggattataggtgtgagccaccgcacccggcctgtacttaacattttttcaaaaggcatgttttacttaaaggaataaaaagttatcaaaatgtagatgatggaaaaagtttgagtagactctaaatggggacagagagaataaggctcagtaaattgtctccctgtacctgatgagaagaaagtcctgagcagcaaacaggaagaccccatgctgcgtggctggcatgcttctttatcaccgaaagctaaccaaaaagcagagatttatttaaaataaatgtcttacgaagcccagaaaagcatccaactcctttcactctgaattctcaataacgccaagtctttgatgcagcatggggtaagctgaacagcaggcatgaataattctccacgagagtacttcccatatgtccactctcccaactcttaaggatcagagtccgaaagcctgactgaaattgagctgctgggaaatgtaatcatgtgagaacaattaaaaattttgctttcaagataagagcttagtacaaagcctagccttagacaaacttatgaaatgaaactatgacaaggaactcttctcccctgggttctcaaccccttagtaccaggaacctacagcctcttctcttccctttcttccctttccttcttttccttcaaatctcctaacctcagaaactttatgcatgctaaaaatattaaaaattaagaacaaaaaatgataactgatcaagctctatttgcattttttcattttttatttttgttaatgatatccttggtttacataatttgcaaatagctttaacttaagaatttaagtgagactattggaaatttaaaaagcaaacagaaaaagtcttctcttttcagtatatgcactactaagagcttaaatccatataagaattttcttgattagtttcagtattttccagatatttattcacatcacattcttgctgcagaacacctttgtgaaatgacatgtttactctcactgttattaggtactcatctgtaacttgtggttaaatcataaagccctgtttaaaagaggtttatgttctctaaggaatgagcatcaactatcctaacccaaggtttcctggcagcacagtgctgtggaaagaacaatgaaataagaatgaagatttgagttctgattctaactgaaacaatgtgaacagctttgtaatattcatagtttgagtctcttaacaattctgtgtatctcaggaggttattacaagaattagttaagataacataaatcaaagcattttataagctatatattcaagaaaatctaaaatttcaaactggccaaaccaggttgagaagtcattttgaacatgatttacagcattgtgacactacttgctcgtctgtacgcacataacaacaccaaacaagccaggtagcacatcctctctagaatggaaaattagttctctgcaggtctagggaacctactgcagacaacactgctctctctctttttttttttaaacctgtgtggaatttttcattttaccatggactgttttaatgttttccagttctatttcctgttctgatacttttggttggtacacttcaggaagagaaaaaatttgggggggcacaaacaaatgacaaaccaatatttggtacctgtggttttacatttatatataagccattcttgtattcaagccttaatgaggatcaatgcacttgaaataaagtatgatttacacaaaaataaactaaaactaaggatagattttacaggaaaagataatggtttaaatacacaagaaacttgcaatccaaaaataataaatcctaatatcctaagaaccataaagaaatgttcaatttgtatttgagacagaagaaacatttgcaagacatgaagtctggtgccatggaaaaattgacagatttactaatgtccaatgatttttatgttccaggccctaattcttgcagacttacaaagtctgcaaacactacactttgccttctttggtaaatgtgtatttctcaaagtgtgtgggcaacatatggaccttgtatgtcttctatgaaccctacaatccagtcattaattcaagttaatcaaaacatgtttattatctttctaaaaatgaaaaatatgctttccactgcagttttgaaactaatttagatttgaaacaattttttgatgttaaaagaagtgcaaaaccttacttagacaaaagctcatgagtctttttaaggttaacaacaaacaggcataagtaggtgctctgctttgttccaaagtcccatttgcctaatcacctacatttctctcatctaaaagaagaataaattgctacgatggagttaattccagcaaaatagggagttcatatggattcgttttcaatattttattatttctcatttgtgaatttgagggggaaagagaggaagaaataaggagggtagaagagattttctataacaggataagtttgacaatatgtttcacatattgaattaagttctttcctttgacatttctcatttgttttctcattaaaggtgtaatcacatgttcaaactgtaattttcaaacttttattttcaaactaccttgagggcttattatatatttgaactgtaatcctactgctgtaaaaacaagaactaagtaagcaaaccctatatttagcaggaaaagaaattccccaaggccagaattattatgctccataaaacttgccaactgcaactgcaactgcaccctcccacatgtaaagggaaaatttagactaaaacattaaaatccaaatgagtaagatataataggtgacctaataaattctggatagctaccacattacagagttttcatctaaaatatttcatagggatagtaattaagttagagagttttaatctaaaatattactaaatgtctaaataaactttaaatatttaatctaaaataaaatcaccaaaaatttttcttatgagtatctaaaacaggaataaaatgcaacttctccaagttgtttcttcctacttagactactgagatttaatacaaagaaaacttttaccaatgttatgtcaaagttttcaatctttaaaatgcaaaattatgtcttttaggtcactgcctgttttgttctgtatcattttctgattccaggatttgaatctttaaaaatactcagaaaaatcttggaacaaacatggagccaaaataaatttgccatccagagagtaggacagaaagtcaaagccgataagctcaaatgtcctttctgctcttttatcttaagagaagcctgtaagtcctccatcttagccaatgctggagagtaagattagaaaaatgggactagaaaaggaatgtttagcattactgtctgcaaacaccacacctggcctgtgtgataggtacagaactgaagaatggagttgggcatcatcacagaccaaatcatatcaaacccgtttgcagagttagttcagagatgcctgggttttaagataaatagagaatgtttatcactgttttttttttaactcacctatgtccctgttgacactgtagaactcaatgtttatgactatagaaacaataccatcaacaaaaataatatctataattatcctctctaatccgcagttattatgatgacataatcactccggagaaattaggtctatgggatagacctgatggaagcctattttgaagataacagtattctcactataccattcagattaacatgtcatcggctaacggccatcattttcttacagatgttcatttccttgtataacctttgcttgacttgttatctgacatttcaattctggtatgtgaatatgtagaaaattaatttattgccttaaccagacaagaacactttgcatatagtgtgtattcttaagtattaggagtgaatttaaatcaaagacaaaatacagaagaacaaatttgttttaaaatgtcgattcatttaaaacaaaagtcaaagttaaaaatcataagcaatacatatttcaaatttataatcttcttttgatataaatattgatagagatgatcaagaccattacctattaataagctgatctacatttgagaaacaaacaaacaaaagaatgcctactgactgggcttcttgccaagagcccaggttaaagtacaaagagactgcagtgtttgatcagcctatgaagtttgttatgaagaacctaggtgtgcttggtcacagtgtatttttaccttcaattattttaaaattgttaaaatacttgcttttttattttttaattgttctttaatctatatcctaaatatttctttttaaaaagttgtaaaactctatgattctcaactttgtactgactacataacaaccttcaaaggacctgttcacgtgactgtgcgctagtagcctctggcctatgacgtgagcttatttaatatttagatagtataagtatatatggaaaaagaggcattttttggccagggaatgccattagaaatgttgtgaggattaaagtagatagtatatataaagtgtctagcataaagccacatagcagaggctcagtaaatgtaaaatgtataaaagtatgtgcatgtgtatctcaagcatggtgctatgctttcatatacttctttccttttccagtatatcccacaatgccctaaaaggatactaatgatgattaggacattggtctgaatttcatatcagaaacatttgtggccagatgcagtggctcacgcctataatcccaacactttgagagaccgaggctggaggatttcttgagccaggagttctagactagcctgaacaacatagtgagacatcatctctacaaaaagtttttttaaaaaattagccaggcatggtagcacacgtctgtaatcccagctgctgaggaggctgagtggggaggatggcttgagcccaggaagttgaggctgcagtgggctgagattgtatcactacactgcaactttggcaacagagagagatcctatcacaaaaaaagaaaaaaaagataaaggagagaatgaaagaggaaggaaggaaggaagggagggagggagggagggagggaggggagagagagagtgagcagggaggaagggggggagagagagagagaaagaaagaaagaaagagagagagagagaaagaaagaaagagaaagagagagagaaataaagagagaaagaaagagaaagaaaagagagagaaagaaagggaaggaaggaaggaaggaaggaaggaaggaaggaaggaaggaaggaaggaaatgtatttcttctttactaaaaaaatataaacactgaaaagagaaacttttgccatcataaaatctacaacccaaccttatctgaattcttaaactctgccttctgttctattacagcaaatgaattttccatgctttcttgcaagaccagccttccagtggatctcatcctctttcctactcaagttatttgtctccacaattctaaccttctttctcctactatatcatcggctctggactagatcattcccatgagcagaaaatattgtctcttttctcttaaaagttcctttcaccctacatctctgtcaagctactgctctatttgttatgggttgaattgtgtccccaaaaggaagatatgctgaagtcctaaacttcagtaactcagaatgtaaccttgtttggaaatagggttgttgcagatggaattagttaagatgaggtcatcttaactaacagggtgggcccttgatccgatatgactgctgtccttttaagaagatagccatgtgaagacacacagggacacacagggagaacgccatgtgatgacaaagacagagattggattatgcggttgcaagccaagaaatgccaaagattgccagcaaccaccagaagctaggaaaaggcatgtaaagattaccctagaggtttcacgggagcatggcccttgccaacaactgtatttcagacttttagcgtccaaaactgtgtgcgagacagtaaagtcacccagtttgtggcactttgttacagcagccctaggagacttataggtcatcagtttcccactctatactaaattattcccatgagcagaaaacattatctcttatctcttagaagtttccttgaccctacatctctcttaagctactgccttattgttttgcttacttttgatggcaaatttcttgagttacctacaattgctgtatttacttctgctcctcccattctcgaatgcactcattctggtcatgatccctcatcccactctccactccccagaagatagctttgtcaaagtaatttattgtactttatttttctttatgacatgtaatattatatgtttatttttaatgtagctattctctgtttcacttactagactctgtaagttccaaaaagacaggggatagatgtattttttaaccatactccaggccctggtacttcatatatcctcaaagaaaattgatgaaatacatttgcttttagatttttaattacatttagtacataaaatttccatttggatataaacactctttgtttatggatggtaatattttgcaaggattttgttataatttttcaagaatttggaagttactactaatatgaagcatacatgctgtgccagcatacattatcacttatattttatcccaaggtaaattatgatgtctttatattgcaccttccacagctattagaagatactaatcttcacattcatcctatgtattaggaaaaagcggtgtttaacttttaatttacagatttggaaattaagggacttaagaccaaagggcctttctgtgatatctaagtggatatatgataaaatgcaaactgggataagaactttgaactgtcaaatcagtttaatttccactaaaatccctcagcagcaacaccaccttataatttcattggcatgtaagattattatcttaattatattaaatgagaaaaaacaacttcctcctggatattaaagcaatttacagatgaggaatatgaaatcatatattatgcaaatatatgcaataaatgaagatttcttgctcagttcttattctgtgggccagcagaaatttagcacaatgaactgaataaaaagagaaaattaaggagcactgttaaatgtattcataaaatgcagtatctaatttgaagggggctatgatcacattagtctatgatgtgatagtttacagtaatcaccacttatatccacataaatttgtcttttccattttctggttgccttgtttatcggtagtaaacagcagcttaatagcaagataaagcagcatattaaagatactgtaactttgctaactgaaaatatcagggatgaattattacactttcttaaattgctatactttctatcaaggcctccatagaagaagaacactatatgttttattcaagctaccttttggacatgagttaatataacaacagcattttagtcatctatgtgtgtacataataacaataattttattaatacattatgttcatatttccactgaactcatcttttttaaaaggatgtcgtgacaatactgatttcatgaagaaagatttgagaaatttcaatgatgaagtgatattggacttcacaacatagaaattatttaaatatacatttgtatgctcttttatcacatcttacttcaaactttagtttaattcaaacgaacttctctctccctcaaagctctgctcatatccctattactctccaatcatttttcacattacctcctccttccaccctagttacgtggaagtggtgactctacactcatctaagatgaattccgtgtctgagctatggacacttttctcttccactgctgcaagccagtcagctgctctctttccttcctctttagccctttcctcacccacctgcggcttcttcccagcagcacccaaacctatacacctactcggtggtgtcctgaagatgctccttctcccagcacaagttttcaccttcttttcaaacaccaacccataagctcaacaatctcacagtatcttcctctactgggcctctcaggagcactgggcattggctgactactccatccgtcttcaagcagtcctgcccttgacttccaggaagccacactttcccagttttccttccatttttcgtattgttttgttagtgttaaatgctagtcattttaaatgttggtatcccttcaaaccttgttctttccctcattctacacatgcttcttgaacaccttatctattccctttgtgtcgattgctacctgttatgggcttagttgtgtcccatcccccacaaaaaaaaattgctatgctgaattcctaacccccagtacctcagaatgtgactctatttggagataaggcctttaaagaggtaattaaggtaaaatgaagtcacatgggtgggccctaatacagtatgattggcattcttataaaaaggtgaaattcagacacagacacagaggaaagactatgtaaagacagagggagaagatggccatccacaagccagggagagacctgagaagaaatcaatcctgtcagcagcctccagaactggaaggcaatatgtttctgttttttaagccatccagcctgtggtattttgttagggcagccctggaaaactaatacactccctctgattagactgtggctcctaaactcattactgtggtgccagctctgaatgccagactgtatccctctacctactggatgtcaccacatggatgtctcaaaaatatttcaagaattcaatgtatgttggctcatccagttacctgtgccagaaacatggtcactgtattagaccctacttgtaccccacatcatatcctcttagcccacctctaattgtagtttcacttcaagtcattctctcatattttttacctcaggttttctttagaattctaataacctgctcagcagctttcaagcatagaggagttaacatccctggaggcaaccctaaaccaaagagaaatgagagtcagagaagaaaggctcagtcttcagtctttcaaagggtcacttctgaaaagctttcaacatggtttctcagggaattcctacaatatgtgccccagggttttacagcaataaatagttcaataatgcaccctttactggctttcttccttccctgaattagattttctccttccctaacacactctcctcattctgtcactcttatttcttgggatcatctctaaaataaacttcctgcatcccagttattgacacagacttgcttttagggagaaaccacactaagagagtcaatatcattcccttatctttctcctttatataccctctctggccatcaattatcaagccatagtaattctactatggttttcaaattgatctactctctttaagtccactgcctttatcttaagataggctatcatcaactcttaactggataatttgctgtcttctgtctccctgccttgcaaattgtcccttaccaagttattttccatggggaagtcaatgtgtgctttctaaatggactatctaatcctactcactcacagtaaccttcaattatttcccattgtctttaatatgagttccttaatatgatttttgaggtttgtcctaataaagacctagttttcctccacagtcacatctctcaccattcctacttcttacttcatacactaatcacactgagctactctcaggtctctgaccagccatgtggtctgtcacctcaggacctttgcacatgctgcctctttctcttgagatgcacttcttcattcctcatctccacttccagcttcttactacttctagtttagaccgcatttactcttgaaaatcttctcatgttaatttttggttaagtgcccctcctatgtgttcttaaaacattacactgtattttaattacctgtctagatttgtttatgtcatctattcaattagagtatttgaagttttctatttctcattgtgtctaaaatgctccacatattttaggtattcaataaatactgatagaataaatgaattaatgagtaaaataaaaatgttaaataatgttaaattttttaacaacaaaaaaactggcaaacaaattttcaaatcatataaaaagagctgaaggaaaacagaagcaaggtggataaatagaaaccctataaaaatctaggacaaaaaccctatcttcagaaatctttgctatcatcattgccataaccatggatacacgcctactcggatttttttaaatgcattacttagaaagcaattttaaagcttatactataaagcaggcatttttaaatggaaaaattaagtcaatcccatatgttagtctggaatggcattttatggagatggctttaatttatgaactcgcccaatagaactgcaaggtgttgaacagagctagccttcactaagacttaaaagtacataacatctgttccaggcctttgactccataatctctcaccctgacaacaccctttctcctcttcctgcttatgctgcaggtccttgctctgaaatctgaagactcctgagtctgcccactgccacacaccttggtgaatgtaagagtctcaccaggatttcctggtgaatttctcttcccagctatcacccatgtaaacagtatgttattactgacactccctatacttccactttgttggatgcaaacaaatacagcatttgagcggacctgtggggatttcaggtcagctgaagtgaagaggttggtttcccaggaaatctacaggaaatacatggagggcaaggcacagccttgatgaaccttacaaactgctctcagtgagtggttctcatcaaggaagcctcaagatggtgaagaatgcatgttctagctgggaccctgtcagcagcgcattgctaccaccaagttaaagttatttccagcacaaaccagtgttgttttgctcaagagaatgcttaatccctaccagcctcttagcaaccgtgtgccattattctcaagagaaggggcagggcaggaacaatattaccccatcactgaaaaaccctcaagttgcagaacatgctaatgatgagctggtaaaaacattgccatcactaactatatgagaaagccactatagaaatcagttccttaaaaacactgtaagactgcatgattattttgattctcaatttaacaggcaataacttttactacaagtaaactttggtttgattccaaagaatagctaacgagatcatgcaaatttcaaaaatacaattccttcacttattcaacagatatttttggggtgcctagtagacactcttctgtgtactgaagaatcatcgatgaacaaaacaggttgccgggtggtggggaggagaaggggaggggatggttaataggtacaaaaaaataattaaaattaatgaataagtcctagtatctgacagcacaacagggtgactatcgtcaataataatttaattgtacatttaaaaataactagaagaatataattagattgcaacacaaaggataaatgcttgagggagtgaataccccatcttccatgatgtgcatataatattaagtggggagaaaaacacaagaatacaaaactatagaatataatacttgagcttataagaacaattaattgaggcatatataggcaaaaataagctttcagacatagatattgatttaggaaaagaaaagaaaacatagatatacataacagctactagtgttatatttggcatgagattaccaatagtattttttaaagtattttctgcgctttctaaaatttcataatgagtacatcatcggtggcaaattaatactacatcatgtatgtttaaatgcaaaaaacaggataagatgccactttattcatcactgccaaaacttggaggcaaccaagatctccttcagtaggtgaatgtaaaaataaacagtagtataggcatacaatggaatattatacagtagtgtaggcatacaatggaatattataaaaagaaataaactatcgagccacaaaaagacatggaggaatttaagtgcatattgataaatgaaagaagtcaatctgcaagggctacatactgtatgattccaactatgtgaccttccagggaaggcaaaactatggcaacaatcaaacgatcagcagttgccaaaaggccgagaggaggcagggatgcttaataggtacaacacagagcattttaggacagtactactattcagtatacaccgtagtggtggatatatattatatattaccaaaccctgacgtacagcaccaagagcgaagcttaatgtaaacagtgggctttagttaataataatgtatcaatactggctcatcaattgcaacaaatatattgcaataatgcaaaatgttactaagagaaacttgtagagggatacaaggaggtttatggcaactctctgctcatttttctgtcgacctaaaactgttctaaaatagaatttattaattttttaagcaataggctaagatgaactctctcactttgaccttccagtgttataggattcaacccatggataatacaggtttgggccgtaaccccaaaagacacaatcctgaaggccataatcccaaatgttgaaatcccaaaagatcaaaatccttaaaatcccaaaaatcaccatcctgaaaagtcaaaattccaaaaataaaactctggaaaaaataaatttaaaaaattatttaaaagacatttgtttacattttcatttttattacttattattattattatttgagacagagtcactttgtcactcaggctggagtgcagtggctcaatcttggttcactgaaacttctgcctcccggtacaagtgactctcgtgcctcaaactcccagaagtacaggcgcacaccaccatgcccagctaattttttgcatttttagtagagatgggatttcgctatgttggccagactggtctgaaactcctgacctcaagtgatccactcaccttggcctcccaagtgttgtgattataggcatgagccaccgcacccagcctacatttttaaaaggaaacttacttgagaaacacgtaaaaacatagctgaacacttcatatgccactttttgcaataaaatgggcaatgataatgacatatttttgcaagaataaaactcaggtatactaacaacagttgcacaagtgtggcagttataagcagacaaactggccgggcgcagtggctcatgcctgtaatcccaacactttgggaggccgaggtgggtggatcaccggagatcagggtttgagacaagcctgaccaacatggtgaaactctgtctctactaaaaatacaaaaattagctgggcgtggtgctgggcgcctgtaatcccagctactcaggaggctgaggcaggagaatcgcttgaagccaggaggcggaggttgcagtgagctgagatggcaccactacactctagcctgggcaacacagtgagattccatctcaaaaaacaaacagacaaacagacagacagacaaactgtattcataaagaaatatgtcttggggaaaagctaaacgtattccccttgaaagccagaacaagacaggaatgccctctctcatcatttctattcaacatagtattggaagcccaagcaagagaaagaaataaaaggcatccaaataggaagagaggaagtcaaactatccctgtttgcaaacgacatgtttctatatctagaaaccccatagtctcagccccaaagccctttaattgataaacaatttcagcaaagtttcaggatacaaaatgagcatataaaaatcactagcattcctatacattaacaatggccaagccaagaacaaaatcaggaatgtaattccattcacaattgccacaaaaagaataaaatacctaggaatatcattaactagggagatgaaagatctctacaatgagaattacaaacactactcaaagaaatcagagatgatacaaacaaatggaaaaacattccattctcatagataggaagaatcaatatcattaaaatgaccatactgccaaaagcaatttacagattcaatgcaatacctatcaaactaccaatgacattcttcacagaactagaaaaacactattttaaaattcgtatggaaccaaaaaagagccctaatatccaaggcaatcctaagcaaaaagagcaaaccaggaagcatcacatttcccaacttcaaactatactacagggctacagtaaccaaaacagcatggtactggtacaaaaacagatacacaaaccaatgaaacagaatagagaacagagaaataaacctgcacacctacaaccatctgatctttgacaaagctgacaaaaacaagcaatggggaaaagactccctattcagtaaaatggtgctgggataattggctagccatatgcagaagactgaaattggaccccttttttacatcatatacaaaaatcaactcaagatgcattaaagacttgaatgtaaaacccaaaactgaaaaaaccctggaagacaacctaggtgataccattctggacataagaactgcaaagatttcatgacaaagatgccaaaagcaattgcaacaaaagcaaaaattgacaaatgggatctaatcaaacttaagagcttctgtaaagcaaaagaaactatcgacagagtaagcaaacatacagaaacaaacatacagaatgggagaaaatatctgcaaattacgtatctgacaaaggcctaatatccagcatctataagaaacttaaataaattttcaagaaagaaaacaaacatccacataaaaaaagtgggcaaaggacatgaatagacacttttcaaaagaagacatacatgaggccaacaagcatataaaaaaaaacgctcaatatcatgatcattagagaaatgcaaaccaaagccataatgagataccatctcataccagtcagaatgactattattaaacagtcaaaaaataagagatgctggcaaggttgcagagaaaagggaatgcttgtacactattagtgagagtgtaaattagttcaaccattgtagaaagcagtgtagtgattcctcaaagagctaaaaacagaactaccattcaacccaacaatcccattactgggtatatatccaaaagaatataaatcattctgccataaagacacatgcactcgaatgttcacttcaacactactcacaatcgcaaagatatagaatcaacctaaattcccatcaatggtagactggataaagaaaatatggtaaatatataccatgaaatactatgcagccataaaaaacaaacaagctcttgtcttttgccagaatgtagatggagctggagaccattatccttagcaaactaatgcaggaacaggaacaaataccgcatgttctcacttataagtgggagctaaatgagaagaacacatagacacaaaaaggggaacaatagacactggggcctagttgagagtggagccagggtgggaagagggagaggatcagaaaaaaattactactgggtactaggcttagtacctgggtgacaaaataatctgtacaataaacccccatgacacgtgtttatctatataacaaatctgcacacgtacctctgaacataaaataaaagtttattttttaaaaaagaaatatgtcaaaagcaaaatgtataaacccatgtaactatggttggtagttgtgagctcccagctttataactgcagtcatctgaaataccatatcagacaacctaattcttttttatttttttttgagatggagtctcactctgttgcccaggctggagtgcagtggcatgatctcagctcactgcaacctccgttccctgggttcaagtgattctcgtgcctcagcctcctgagtagctgggattacaggtgtgcaccaccacacccggctaacttttgtatttttagtagagatggggtttcaccatgttgatcaggctggtcttgaactcctgacctcgtgatccacccacctctgcctcccaaagtgctgggattacaggcgtgagccaccgtgcctggcccctaacctaattcttttaataagatcaatcaaagaccatgatggggtcatcaccacatatgcagtcacccaaagagttgagagcttgagaattttatctttcacaaatgcagatgtacaaaagggacatctcttcatttactgaggaagtttcaacatttttatatacatacacaatacttacacggaaagaaccttgtgccaatgcacttttgtggagtcaaatttgcaaaaaaaatgcataaaataaattagcactctctaaaagtttttgcacaatttatacctccagtattggaaatgatgcaaagataagatacgtagcatagcaaattgacacaatgtggaagtggcagaagttacatgtgattgaataatttggcagaagagatttcttctgtgttttcacttctatgattgaaatacttgctgcacttgtgtttagagagtggttgtaacctataaattttgtaagtatatgctgtccatttgaaaatctggttattgcttggccattgcaattaaacaattttctactttcacaacaccaataataattaattttcaaacttatatctttcatagttaagtagctttgtacacttaatttatcacagcctttatgcatggggataatttcactgatctcttcctttgtgtttcaagaaatgcagtaagaaggaataatatttggctttcccagtatcgaatctgtgttagggttcaccagagtaacagaaccagtaagatatgtatatagacacatgacagggaatctaatagtggaattggctcatgcaattatggtggctgagaagtccaacagtctgcaagctggagaccctggaatgtgagtaatgtggcttagtccaactcagaaggcctcagaatcaggaaagccaatgttataactttgtctgaggccaaaagtctcagaagctgggagaccactggtgtaagctctggagtccaaaggtcagcaagcctggagttctgatgttcaaggcagaaaaaagtctgtcccaggtcaggcatggtggctcacagctgtaatcccagcactttgggaggccaagacagaaggatcacttgaggtcaggagttcgagaccagcctggccaacatggtgaaactaaaaaatacaaaaattagccggcgtggtggctcatgcctgtaattccagctacttaggaggctgagacatggagaatcgcttgaacctgggaggcggaggttgcggtaagccaagattgaaccactgcattccaccctgagggacagagtaagactctgtctcaaaaaaacaaaaagaaaagtgtctcagctctcagagagagaccaattctccttctatatttgttcactctgtgccccctgccgattagagggtgtccaccagcacagaggaaaggatttccccacctagtccactcagactcacacactcatcttctccagaaacaccttcacacacatacccaaaataatgccctaccaggtttctaggtatcccttaatccattcaagttaacacctaaaattaaatccacaaaacttggcacccatatgcatctccttaaaccatacttaatttccaaataatgacagtaacgaggtaatagttctgcctaacatggtgcaacgagcataatgcatctatcttgcataaaataaaaaacacactaattccttccttagaattcagctttcaggatttaaacatttggaatttaatctttcaggggtataattttcaagattttagttattagcaatttagatattagcgacttttacggatttcaagttttcaggatttcaacatttgggactatgtattttaggattatgattgatactgaacaaaacagtgattcccagatcttggaactttagaaacaataaaattttccttaaaaggttaaggggagaagacaaagagttttccactcctcctttgccaagtaagcacactaaacatacacatgtgtatctgcacacacacacacacatacacacacacatataaccagacaatattccataaaaaagaatctctcttcacagtattccattaaggagaaggacattttatcacataaaaattaagagtatgattttttaaactctttatggctttttttatttagcataattattacacaattcatttttgttgtatgtatcagaagttcactgtttttattgcttaatagtattccattgtttatatccaacaatttgtttatctgggcatcagcaaaagagaccatttaggtttttttctatttttggctgttgcaaatgaaatggttattaacattcatatacaagtctttgtgtggatgcatgctttcttttttgttttttgttttttggataattacctaggagtggaatggcttaattctatagtaagtgtattttattttattttattattttactttaggttctgggatacatgtgcagaatgtgcaggtttgttatataggtttacacgtgccatggtggtttgcttcacctattaacccatcatctaggttttaagtcctgcatgcattaggtatttgtcctaatgctctccctccctttgccccccaccccccgacaggccccagtgtgtgatgttctgctccctgtgtccatgtgttctcattgttcaactaccacttatgagtgaaaatatgcagtgtttggttttctgttcctgtgttagtttgctgagaatgatggtttccagctagacccatgttcctgcaaagacatgaactcatcgttttttatagctgcacagtactccatggtgtatatgtgccacattttccttatccagtctatcattgttgggcattggggttggttccaagtctttgctattgtaaatagtgctgcaataaacatatgtgtgcatgtgtctttaaagtagaatgatgtataatcctttggctatagacacagtaatgggattgctgagtcaaatggtatttctggttctagatctttgaggaatccccacactgtcttccacaatggttgaactagttcacactcccaccaacagcataaaagtgtccctatttctccagcgccttgccagcatctgttgtttcccaattttttagtgatagccattctaactggtgtgagatggtatctcattgtggttttgatttgcatttctctttttttgtttgtttctttgtttgtttgagatggagtctcactctgtcgcccaggctggagtgtagtggcatgatctctgctcactgtaacctccatctcccaggttcatgccattctcctgcctcagcctcctgagtagctgggactactggcacccaccagcacgcccggctaattttttttgtatttttagtagagacagggtttcaccatgttagtcaagattgtctctatctcctgacctcgtgatctgcctgccttggcctcccaaagtgctgggattacaggcgtgagccactacacccggccttgatttgcatttctctaatgaccagtgatgatgagctttttttcatatgtttgttggccacataaatatcttcttctgagaagggtctgttcatatccttccaacactttttgatggggttgtttgatttttcttgtaaatttgtttaagttcctcgtagattctggatattagatctatatcagatggataggttgcaaaaattttctcccattctgtaggttacctgttcactctgatgatagtttattttgctgtgcagaagctctttaattagatcccatttgtcaattttggcttttgttgccattgcttttggtgtcttagtcatgaagtctttgcccatgcctatgttttgaatggtattacctaggttttcttctagggtttttatggttttaggtttaagtctttaatccatcttgagttaatttttgtataaggtgtaaggaaggggtccagttttagttttctgcatatggctagccagttttcccagcaccatttattaagtagggaatcatttccccattgcttgtttttgtcaggtttgttgaagatcagatgattgtaaacgtgtggtgttttgtctgaggcctctgttctgtctcccctttcgtctataagtctgttttggttcctgtaccatgttgttttggttactgtagtcttgtagtatagtttgaagtcaggtagcatgatgcctccagctttgttatttttgcttaggattgtcttggttatacaggctcctttggttccatatgaaatttaaagtagtttttcaaattctgcaaagaaaggcaatggtagcttgatgggaatagcagtgaatctataaattactttgggcagtatggccattttcacgatgatttttcctatccaagagcaggaaattttttccatttgtttgtgtcctctcttatttccttgagcagtggtttgtcattctccttgaagaggtccttcacatcccttgtaatttgtattcctaggtattttattctctttgtagtgattgtgaatgggagttcactcatgatttggctctctgcttgtctattattggtgtataggaatgcttgcgatttttgcacattgattttatatcctgagactttgctgaagttgcttatcagctttaggagttttggggctgagacaaggagttttggggctgagacaatgggtttgtttgtttttgagacgaagttttgctcttgttgcccaggctggagcgcaatggtgcaagcttggcttaccgaaacctctgtctcccgggttctagcaattctcctgcctcagcctcctgtgtagctgggattacaggcaagtgcaaccacgcctggctaattttgtatttttagtagagatggggtttctccatgttgttcagggtggtcttgaactcccaacctcaggtgagccacctgcctcggcctcccaaagtgctgggattgcaggtgtgagccaccatgcccagccaacaatggggttttctaaaatatacaatcatgtcatctgcaaacagagatagtttgacttcctctcttcctatttgattacctttatttctttctcttgcctgattgccctggccggaactcccaatactatgttaaataggagtggtgagagaggccatccttgtcttgtgctggttttcaaagggaatgcttccagcttttgccattcagtataatattggctatgggtttgtcatagatagctcttattatttttagatatgttccatcaatacccagtttattgagagtttttaccatgaagggatgatgaattttatcaaaggccttttctgcatctattgaggaaatcgtgtggtttttgtcattggttctgtttatatgatggattacgtttattgatttgtgtacgttgacccagcattgcatcccagggacgaagccgacttgattgtggtggataagctttttgatgtgctgctggattcagtttgccagtattttattgacgatttttgtgtcgatgttcatcagggatattgacttgaaattttctttttttgttgtgtccctgccaggttttggtatcaggatgactgagaggagttcctctttttctattatttggaatagtttcagaagtaatggcaccagctcctctttgtacctctggtagaattcagctgtaaatccatctggtcctgggatttttttggttggtaggctattaattattgcctcaatttcagaacttgttattggtctattcaaggattcaacttcttcctggtttgctcttgaggggatgtatgtgtccaggaaattattcatttctcctaaattttctagtttatttgcatagaggtgtttatagtattctctgatggtagtttgtacttctctgggatcagtggtgatatctccttcatcattttttgttgtgcctatttgatttttctctttttctttttttttattatactggaagttttagggtacatgtgcacaacgtgcaggttagttacatatgtatacatgtgccatgttggtgtgctgcacccattaattcatcatttaacattaggtatatctcctaatgctatcctgccccctccccccaccccacaacaggccctggtgtgtgatgttccccttcctgtgtccatgtgttctcattgttcaattcccacttatgagtgagaacatgcaatgtttggttttttgtccttgagacactttgctgagaatgatggtttccagcttcatccatgtccctaaaaaggacatgaactcatcattttttatggctgcatagtattccatggtgtatatgtgccacattttcttaatccagtctatcattgttggacatttgggttggttccaagtttttgctattgtgaatagtgccacaataaacataagtgtgcatgtgtctttataacagcatgatttataatcctttgggcatacacccagtaatgggatggctgggtcaaatggtatttctagttctagatccctgaggaatcgccacactgacttccacaatggttgaactagtttacaatcccaccaacagtgtaaaagtgttcctatgtctccacatcctctccagcatctgttgtttcctgactttttaatgatcgccattctaactggtgtgagatggtatctcattgtggttttgatttgcatttctctgatggccagtgatgatgagcattttttcatgggtcttttggctgcataaatatcttcttttgagaagtgtctgttcatatcctttgcccacttgttgatagggttgtttgttttttcttgtaaatttgtttgagttctttgtagattctggatattagccctttgtcagatgagtagattgcaaaaattttctcccattctgtaggtttcctgttcactctgacagtagtttcttttgctgtgcagaagctctttagtttaattagatcccatttgtcaattttggcttttgttgccattgatttcagtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcatcatttattaaatagggaatcctttccccattgcttgtttttctcaggtttgtcaaagatcagatggttgtagatgtgtggtattatttctgagggctctgttctgttccactggtctatatctctgttttggtaccagtaccatgctgttttggtaccagtaccatgctgttttggttactgttgccttgtagtatagtttgaagtcaggtagcatgatgcctccagctttgttcttttggcttaggattgtcttggcaatgcgggctcttttttggttccatatgaactttaaagtagttttttccaattctgtgaagaaagtcattggtagcttgatggggatggcattgaatctataaattaccttggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttgttttctttgacgcaattgcaagtgggagttcactcatgatttggctctctgtttgtctgttattggtgtataagaatgcctgtgatttttgcacattgattttgtatcctgagactttgctgaaattgcttattagcataaggagattttgggctgagatgatggggttttctagatatacagtcatgtcatctgcaaacagggacaatttgacttcctcttttcctacttaaataccctttatttccttctcccacctgattgccctggccagaacttccaacactgtgttaaataggagtggtgagagagggcatccctgtcttgtgccagttttcaaagggaatgcttccagtttttgcccattcagtatgatattggctgtgggtttgtcatagatagctctcattattttgagatacatgccatcaatacctaatttattgagagtttttagcatgaagggttgttgaattttgtcaaaggccttttctgcatctattgagataatcatatggtttttgtcattggttctgtttatacgctggattacgtttattgatttgtgtatgttgaaccagcctcgcatcccagggatgaagcccacttgatcatggtggataagctttttgatgtgctgctggatttggtttgccagtattttattgaggatttttgcatcgacattcatcagggatattggtctaaaattctctttttttgttgtgtctctgccaggctttggtatcaggatgatgctggcctcataaaatgagttagggaggattccctctttttctgttgattagaatagtttcagaaggaatggtaccagctcctccttgtacctctggtagaattcggctgtgaatccatctggtcctggactttttttggttggtaagctattaattattgcctcaatttcagcacctgttattggtctattcagagattcaactttttcttggtttagccttgggagggtgtatgtgtcaaggaatttatccatttcttctagattttctagtttatttgcatagaggtgtttacagtattctctgatggtagtttgtatttctgtgggatctgtggtgatatccccattatcattttttattgtgtctatttgattcttctctcttttcctctttattagtcttgctagtggtctatcaattttgttgatcttttcaaaaaaccagctcctggattcattgattttttgaagggttttttgtgtctctatttccttgagttctgctctgatcttagttatttcttgccttctgctagcttttgaatgtgtttgctcttgcttttctagttcttttaattgtgatgttagggtgtcaattttggatctttcctgctttctcttataggcatttagtgctataaatttccctctacacactgctttgaatgtgtcccagagattctggtaagttgtgtctttgttctcgttggtttcaaaaaacatctttatttctgccttcattttgttatgtacccagtagtcattcaggagcaggttgttcagtttccatgtagttgagcagttttgagtgagtttcttaatcctgagttctagtttgattgcactgtggtctgagagacagtttgttataatttctattcttttacatttgctgaggagtgctttacttccaactatgtggtcaattttggaataagtgcagtgtggtgctgagaagaatgtatattctgttgatttggggtggagagttctgtagatgtctattaggtctgcttggtgcagagctgagttcaattcctggatatccttgttaactttctgtctcattgatctgtctaatgttgacagtggggtgttaaagtctcccattattattgtgtgggagtctaagtttctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctcttttatcagagactaggattgcaacccctgcctttttttgttttccatttgcttggtagatcttcctacatccctttattttgagcctatgtgtgtctctgcatgggagatgggtttcctgaatacagcacactgatgggtcttgactctatccaatttgccagcctgtgtcttttaactggagaatttagcccatttacatttaaggttaatattgttatgtgtgaatttgatcctgtcataatgatgttagctggttattttgctcattggttgatgcagtttcttcctagcctcgatggtctttacaatttggcatgtttttgcagtggctggtaccagttgttcctttccatgtttagtgcttccttcaggagctcttttagggcaggcctggtggtgacaaaatctctcagcatttgcttgtctgtaaaggattttatttctccttcacttatgaagcttagtttggcaggatatgaaattctgggttgaaaatttttttctttaagaatgttgaatattggcccccactctcttctggcttgtaaagtttctgccaagagatcagctgttagtctgatgggcttccctttgtgggtaacctgacctttctctccggctgcccttaacattttttccttcatttcaactttggtgaatctgacaattatgtgtcttggggttgctcttctcaaggagtatctttgtggcgttctctgtatttcctgaatttgaatgttggcctgccttgctagattggagaagttctcctggataatatcctgcagagtgttttccaacttggttccattctcccagtcactttcaggtacaccaatcagacatagatttggtcttttcacatagtcccatatttcttggaggttttgtttgtttctttttattcttttttctctaaacttctcttctcacttcatttcattcatttgatcttccatcactgataccctttcttccagttgatccaatcggctactgaggcttgtgcattcgtcacatagttctcgtgccttggttttcagccccttcaggtcctttaaggacctctctgcattggttattctagttagccattcatctaatttcttttcaaggtttttaacttctttaccatgggttcgaacttcctcctttagcttggagtagtttgattgtctgaagccttcttctctcaactcgtcaaagtcattctctgtccagctttgttccattgctggtgaggagctgcgttcctttggaggaggagaggtgctctgatttttagagtttccagtttttctgttctgttttttccccatctttgtagttttatctacctttggtctttgatgatggtgatgtacagatggggttttggtgaggatgtcctttctgtttgttagttttccttctaacagtcaggaccctcagctgcaggtctgttggagtttgctggaggtccactccagaccctgtttgcctgggtatcagcagcggaggctgcagaacagcggatactggtgagcagcaaatgttgttgcctgattgttcctctggaagttttgtctcagaagagtacccagacatatgaggtgtcagtctgcccctactagggggtgcctcccagttaggctatttgggggtcagggacccacttgaggaggcagtctatccgttctcagatctccagctgcatgctggaagaaccactactctcttcaaagttgtcagacagggacatttaagtctgcagaggattctgctgccttttgtttgtctatgccctgcccccagaggtggagtctacagaggcaggcaggcctccttgagctgtggtaggctccacccagttcgagcttcccggctgctttgtttacctactctagcctcggcaatggtggccgcccctcccccagcctcgctgccaccttgcagtttgatctcagactgctgtgctagcaatgagtgaggctacgtgggtgtaggaccctctgagccacgtgcgggatataatctcctggtgtgccgtttgctaaggccattggaaaagcgcagtattagggtgggagtgacctgattttccaggtgccatctgtcacccctttctttgactaggaaagggaattccctgaccccttgcacttcccaggagaggcaatggcgtgccctgctttggctcatgctcggtgcactgcaaccactgtcctgcacccactttccgacactccccagtgagatgaacccggtacctcagttggaaatgcagaaatcacccgtcttctgcgttgctcacgctgggagctgtagactggagctgttcctattcagccatcttggctccacccctctctttttctttactagtctagctaatggtgtgttttgttaatcttttcaaaaaaaaacagttcattgattttttgaagggtttttcatgtctctatctccttcagttctgttctgatcttagttatttcttgtcttctgctagcttttgaatttgtttgctcttgcttctctagttctcttcattttgatgttcgggtgttgatttcagatctttctagcttttggatgtgggcatttagtgctataaatttccctcttaacattgctttagctatgtcacagagattctggcatgttgtctctttgttcttgttggtttcaaataacttctttatttatgccttaatttcttatttacccagtagtcattcaggagcaggttgttcaatttccatgtagttacatggttttgagtgactttcataatcctgagttctaacttgattgcactgtggcctgagagactggtatgatttccgttcttttttcttttcttttcttttctttttttttcagctggagtcttgctcctttgcccaggctggagtgcagtggtgagatcttggctcactgaaacccctgcttcttgggttcaaacgattctcctgcctcagcctcccaagtagctgggattacaggcatgcgtcaccatgcctggctaatttttgtatttttagtagaggcagagtttcaccatgttggccaggctggtctcaaactcctgacctcatgatctgcccacctcagcctcctaaagtgctgggattaccggtgtgagccactgtgcctggccaatttcctttcttttgcatttgctgaggagtgttttacttccaattacacagttgattttagaataagtactatgtgatgctgagaaaaatgtatattctgttgatttgaggtggagagttctgtagatgtctattaggtctgcttggtgcagagctgagttcaatatccttgttaattttctgtctcattgatctgtctcatattgacagtgtgatgttaaagtatcccactattattttgtggaagcccaagtctctttgtaggtcattaagaacttgtttaatgaatctgggtgctcctgcattgggtgcatgtatattcaggatagttagctcttctcattgcattgatccctttccattatttaatgctcttctttgtcttttttgatctttgttgctttaaagtctgttttatcagagactaggattgcaacccctgcttttttttttttgctttccatttgcttggtaaatatttctccatgcctttattttgagcctaagtgtgtctttgcatgtgagatgggtctcctgaatatagcacactgatgggtcttgactctttatccaatttccaacctgtatcttctaattggggcatgtagcccctttacatttatcgttaatgttgttatgtgtgaatgtgatcctgtcatcatgatgctagctggttattttgcacattagttgaagcagtttcttcatagtgtcattgatctttatattttggtgtgtttttgcagtggctggtaccggtttttcctttccatatttactgcttccttcaggagctctcgtaaggcaggcctggtggtgacaaaatcccttagcatttgcttgtctgtaaaatattttttcctttgcttatgaagcttagtttggctggatatgaaattctgggttgaaaattcttttctttaagaatgttgaatattggcccccactctcttctgtcttgtagggtttctgcagagagattcgctgttagtctgatgggcttccctttgtaggtaacctgacttttctctctggctgcccttaacatttttccttcatttcaacctagagaatctgaagattatgtgtcttggggttgctcttctcgatgagtatctttgttgtgttctctgtatttcctgaatttgaatgttggcctgtcttgctaggttggggaagttctcctggataatatcctgaagtgtgttttccaacttggttccattctccccgtcactttcaggtacaccaatcaaacgtaggtttcgtcttttcacatagtcccatatttcttggagactttgtttgttccttttcattcttttttctctaatcttgtctttacccctcatctcactaagttgatctacagtctgatatcctttcttccacttgatcaatttggctagtgatacttgtgtatgcttcatgaagttcttgtgctgtgtttttcagctccatcaggtcatttatgttcttctctaaactggttattctagttagcaattcctgtaacctgttatcaaggttcttagcttccttgcattgggttagatcatgctctttagctcagaggagtttgtttttacccaccttctgaagtctacttctgtcaattcatcaatcaccgtctccgtctagttttgtgcccttgctggagaagagttgtgatcatttggtggagaagaggcattttggtttttggatttttcagcatttttgcattagtttttcctcatcttcttggatttatctacctttgatctttgaagctgatttttggatggggtttttgtgtgggggtcctttttgttgatgttgatgttgttgctttctgtttgttagttttccttctaaaagtcaggcccctcttctgcaggtctgctgtagtttgctggcagtccactccagaccctgtttgcctgggtatcaccagtgaaggctgtagaatagcaaagattgctgcttgctccttcctctagaagctttatcccagaggggcactggcctgatgccagtcagagctctcctatatgaggtgtctgtcaacccctgttgggaggtatctcccagtcaggaggcacaggggatcagggacccacttgaggaggcactctgtccttcagcagagcttgagcactgtgctaggagatctttccttgtcaggatccactgctgtctttggagctggcaagcaagaacctttaagtccgctgaagctgcgcccacagtctccccttcccccaggtgctctgtcccaggtagatgggagttttatctataagcccctgactggggttgctgcctttctttcaggcatgttctgccctgtgaggaagaatctagagagaaagtctggccatagtcactttgccgtgctgtggtgaattccacccagtccaaacttcctggcctccttagcactgtcagggaaaaattgcctactcaagccttagtaatggcagacacccctctccccaccaagcttgattgtcccagatcgacttcagactgctgtgcttgcagtgagaatttcaagccagtgcttcttagctttctgggctctgtgagagtgggacccactaagctagaccacttggctccctggcttcagcttcctttccaggagagtgaacagttctgtctcgctggggttccaggcaccactggggtatgaaaaacactcctgcagttagctcagtgtcttcccaaacagccaccccagttttgtgattgaaacccaggtccctggtggtgtaggcacacgagggagtctcctgatctgcggattgcaaaaaccatgggaaaagcttagtatccaggctggatagcacagtccctcacagcttcccttgggtaggggagggaggtccccagcactttgcacttcctgggtgaggtgatgccacaccctgcttctgctcaccctccttgggctgtacccactgcctaaccagtcccagtgagatgaactgggtacttcagttggaaatgcagaaatcaccccccttctgtgttggtctcactaggagctgcagactacagctgttcctatttggtcatcttgccacatccccgagtataatcttaaaataaggaaaattcctttaactgtaataatcttggacctatttacaaacttactccattttgtgatttttctcattttaccatgttcttatgaacatatcatctgacacctatatcacactggctgggaatcacaggtctatgacccagtgttttgcctcatgacagtttgcatggagagggctgtgctgaaaaagtcaggacccttcagccttgttttccaaaggatggagagtcagtttcccaaagtcagcccttctgggccctcagagcagttggctggttgcatgcttcctattgttgttcttcatcatttatcatgggtgtggagtcatgtgaaatgtgcaaatgctaactcaatgtagacagcgaattagtcttccacagtgaccatttgatatgcttatttccttgaaattcttatacctgttcctatgacacagaactatgagcatatgttcacagaccagattctcctagtaatacctttagagtatggttcactgagaaatcaatgacatgataatggagttctgtcagaggaggcaggtgatgttactcaccagaaatcccaaataggtactcactgctcctcaacaagtaaaggctcagaacttccagatccagtactgtggtccactgcctcttctacagatgctcttctctgccccaggcccacagtatctcaaggttactgtggcttagatagcatttacctttatatctgaaagagagtagagaatgaggggacatttgtgttgaggtccaggaatcagacccatctgggtgttatgggttattttatgattactggaaacaaaaaagatttccttggcacacaatattcagggggaattcctgattcctccatccagctaaattctctttccatcgaactaaagcaagtggggactcctggaataatgcaaggctttgatggcaaagtccctgaacacggggaggggagtcacacacatccctctcttcctctcaatttcaggacaaggaaggataagtccacattcttcctatcaaactctcactagagattagaaatagagactttgaactgtgccttgggcatctcctcaggcactggagcagatgtagctctgagaagaaaacagcatggccgcatccttttatccagctcctgctctataaattggcaaagggaactcatcttttattctagttctatataatttactccaaattaaggaggaattcttaattataaatgttaagcagaagttgcaaatatgtaagtttaatgcctctgtttaagagaggcattaataagagaagattgatctttcttctaagggtactggtctttcaagagaaaagtaatcttacacaattgatagaagaggttagtgctatgataaaatttaatacatccattgtgcaccattgaaattatttgacttcactcactgactgctgtttctgctaaattgatatcttagatctaagagtgatttgccatattctagataggactaagcggcctggtgcaaaataaccctgaagtgttcacgactgacccctcagcccagacaaaatcatggagatgcagaccacacaccaaattgaagctgaaaacgtgagatacctgggattatcacagccatccagagagcatccttctccatacacataaattaaggcatgtgccctatgccctttctccaatatgattttcctctaatccttggaaccactagaagaacactaactgcctgactctcctattctcctgacaataccacagatgaattaggaacccattttcctaattctctgtgtgttggtttgtttggacagttactctagtgaaatcgagtcttcacaacaaaagatagaggacccagactaagcaacttgcctaaacctgaggactagagtcacttttatcatggctcattgacatgatacattgacatataacgctctcctgagacagttacactcccaccttctccctctattcctattcctggttattccaaacctctccttctcctgttcttcaccttccagatgtactggttagcatcttctcctcatggctgagaaacaatggcttactatcctgtttgccaatccttgttccaccttccttcaagtctttcttcctcattcagagaatgaatattattgcttctcagttttttggctaagattaagtgagaatgaatgagtgaatattaattttatcttgtgattaagtgagaatgaatgagtgaatattaattttgtcttgtacttattgtagtaacttctatataaaattttaaagaggacaacatttctgtctcaacaccgtcttgcctttcgcaacctttcagacaaacatctcaggcttccatattttccctattgtctgctctaacgtaacatgatttccaggaaagataataaattgctcactgtaaggtaaaaggttgcaaagtttatgcctttccaaagagatttgctttaacacaggaccaaaatttcaatttccaattctggaaatgcaaaatcagtaagaaatcttggagaaggacaattttctggtatcctttaaattatacccctacaaacattgtgttcaaataacaactcactcatggttcataaaatcattttcatggattaatatcagtttattttttaatagaatggaaggaaacaaatatcaatgtacatcaattagagtaagcgtaaacttttttttagaattttcatttccgttttttataaatgtacaacatatatatgtatatgtaattataagcaaaatatataaatgcatttcttgttatgatcatcatcaaaaagtttgaaagttacctgcccctcacccctagatcatgttaccaaatgcttttgattcctcttgtgcaacttcactaacatgcatccctgcttttccatccccatcactgtccacataggtcagattattcatttccgttctgaagttctacaataatcacaaagcctacataactgctgtctcttacatttttctgggtgtttacagtctctaagtcaaattatttcctaattcaaactctgaaatctgtgcaagacaaaaatctgaattcctgtgcctagccctcaaccatctggcccatttttaccttgccaaaccttatctcctgcagttacccaacttgcctccaggcattcttctcttttctgcaccagatctctgctcaaaccatcctcctcccactctttagcttgaaatggctcccttgcctcatcttcacggcatcttatcagtccctgaatccttcaagtctcagcccccttcccatgtccttcatcccccagtgaatgcattcactgaccaccccatacttctgagaaagccttaaatcttattatttttaaccttttcactggtgcacattattggtgtactcatattttctgttactttctacattcttatcttacctttccaaggagattttaagttccttaaaagaaaatatatcttaagtttttctagcttgttgcacttagagcaaaggtcctccataaaaatgttttgattgatttttcctactgtacacatgatgctaaggtcactgtgacccaatagttgaaaaattggccattaattttaaaaatacatactattgtgcttattttttattttccatcttatttcgttttctaaactaatagttattatccttaaatcacttctgagcaattaattttaactttttaaccaactgtactactactactaataataataatactcatttttctttcttcaaccctctctgcaggaagttttaatgtgaaaaataatttaagtcattaaaacaataaatactctgaattgaggtgtaatgggtgacctttatgatagtttcttctcactagagagattgactcacaagttacataaatacttagaaaagatatctatgggggaattcaaacatcagataatgattgaactttttgaatttaccatttcaaccttgaaatcctgtaattctaaattccacttgctgagtaagtagattctgaacaaccaaaagttgcctgttccctccttgccacctcacctctgaaatatgccctgtaatttacttacattcacaatggttcattaaagtaaccataacaaagcttacagttaatgataaattacaagaaaactagctctttagtctaacattgtgtggattatcatttggatttgtaaaaaattattatgtatataggtattataatgtttattacccttgtctgggcttacttatattttaacaaaacgaatagttattctttatattcctaaagtgttaagataatggacagcctgagaaatgataacagtgacccccctccaacaggaaagactgggttgaaaacacagtgaagatatagcccacattttataaatctttgattaaaacagaagagtcatcagtaagatcagtaaaaagaaaaggatgtctcctttcataacttctattcagcattatactgaaggttctagccacggcaattaaacaagaaaaagaaattaaagacatccaaactgaaaagaagtaaaactaactctatttacaaatgacatgatcttgtatatagaaaatcctaaggaatacacacatatacacacacacacaaactattagagctaataaattagttcagtgaggtaacaggacacaagatcaatatacaaaactcaattatatttctgtacactaggaatgaataatctgaatataaaattaagaaaataattccatttaaaataacactaaaaggaataaaatacttagaaataaattaaagagttgcaacactttgtactaaacactacaaaacaccattgaaacaaattttaaaaggcctaattaaatggagaaacattttatcatcaccggtcagaagacttaatttttttaaatggtgatactctacaaattatctagaaattcaatgaaatccttatcaaaatctcagctggctttttttttgaacaaattgacaagcttatatcataattcatataaaaatttaaggaatatagaatagccaaaaaataataaaaaatgaggatcaaacttgtttgacttatattcccagatttcaaaacttggcataaagatagacatacagattaatgaaatagacttgagagttcaaacacaaactcatacattcattaatgaggtaactaattttccacaagggtgccaagactattgagtggagaaagaatagtctttttcaacaaatggtcctgtgacaaccagatatccacatgaaaagaatgaatttggacccctaactaacaccacatacaaaaattaactcaaaagagatcaaaggcctaaatatccagctaggattataaaactcttagaacataacatcggtataaatcttcatgaccttggattagacaatggtttcttagatttaacacctaaagcataagaaagaaaagtgtatatacatttgacttcatcaaaattaaaaacatttttaccttaaaggatacttttcagaaaatgaaaagacagctcacagatacaaaaagatatttgcaaatcatgtattcagtaaagctctagtatccagaatatatacagaagttgtatgattcaacaatttaaaaaaaaaaacaatttaaaaacgaacaaagagcttgaatagacatttatccaaagaagacatacaaatgaacaataagtacatgaaaagtcattcaagattgttagtcattagtgttagtcattgggggaataaaaaccacagtgaaatattacttcacagccactaggatggctataatgaaaggaggaacaagatgtgtcggcaaaggtgaagaaattgaaaacctcacacattgctgttgaaatgcaaaatagtatagccacttggaaacagtttgtcacttcctcaaaaagttaaacacagagttaccatatgacccagcaattccactcctgtatatataacccccaaattgaaaatgtacattcacagaaaaattgtacagaaatgctcagagcagcattattcacaatagccaaaaagtggaaataaccaaaatgttcaccaacggatgtctggataagcaatatcattagataaataataaattagaatatcattcagccataaaaagggataaattactgatgcttgccaaaacttggatgaatcttgaaaacattatgttaggtgaaaaaagtcagacacaaaaggccacatattgtaggattctatttatagcaaatgactagaagaggcagatctctattacaaggacaaaaggtagattagtgtttttgccaagggcttgggggaatgggggcatggggagtgactgcttataggtttggggtttttcaatgataaaaatgttctgaaattagataatggtgaggagtacacaaccttgtgaatatactaaaaactactgaattgtacattttatttaaaggggcaggttttatggtatgggaattgtatcttaattcaaaaataatgaaaaagaaagatcaaactacttacagtagatcaaaccacctgtagttatctgtgaacacacttgacttatgcttgcaaccagtgctatcaaactatcagtggtttagaaccaatttttttttcaatttcctctcagttttggaccaatacttttaaaactacaataggaagaaattactagcagaacaaaataaacacacttaaaattactctgttaaattgctatgagagttcctaaaagtttactctcaattgccgtgcttatttcattatggactgggtaagaaacagtttgtaggtcagcatgggtccatggcccacactttgagtatcactgttttagactatatattcttcaaggacagaggcatgttttattcacctctgaatctgctcaggtagcgcaaaatgggcacgggtaggaaagattgctcactggttaaattgaaccaatcaacctacttctaatggcagcttcagcaataaacaaatcaatcgattcaggccaccagtgttagaaacttgctaggatcagctcaactcctaatcaatcgtgtatagggccatgggttcataataacaacattatgcttccacattaaatggcaaatgtgctttcttcatttcacatgtttataccttacctccattaagtgggtggcatcatttaggaaataaataacatataatcaaaacaaagccaaaaatagaggcaagaatcctttcagctctcaagtggcaaatcatttcagtgttgaactttgatatacaattcatagattatttacagaaagtgctttctaatgttgctaagaatagccctagttttttgttttttgtttttttttaagatggaaaacagtgtggaatttgaaaaatgttttaaaattcctttacctgaaatgccagcaattatgcaagtagctaccagaccaagagagtgtttgcgaaacagagttgaaaactgggctagggtaccgtaacagattttctaatacctgttcattattattgcaaagggcatgtggagctattattttaaatctctacacaccctatcagctagtctgagaggattttagctgacaaggccctgggaacaagattttttcaggcttagttatgtggctgattctatctgaggcctgaaaaaatacactccatttacttgatcaccgccagagaggaaacaaagattcctatgtgtggccccctttaaagaagtggaacagtgctatgctaggtacaacagagtcagccagcctggaacagaagccacagcagctttgcccagattagagctgtaattccacgttccaaaatgtctggccaccaaaggacagccttttcataggagtgtgttattactttttatttgttagaggggatgttattctacttcctgaaagaaataaataaagtgagattatgtgagtctggccaactttatatccttacatattaacacttaattaggtaactctgatttattatactgctgaagaatttgtaaagcaagtaaatggctacataaagtttctcacataaatgtaaggatagaaacttccataaagatgatttaatatagtgcattatgtcatagtacagacaaacagcagtaatttgtcttgttttacagaaaatttactgtgtggaaaatgaggagtgctaagttatattagccaaagaacaattacttatcaatgttttttataatgacagtgtgtttctcctttggcatatgcacacacacaaacacagagggatacacacagtataacttgacaaagaagccattcctttagaatgctggtacaattgttagcatttcatgtaaaagagcttttccaatattttttcaaactccttccctctcttttttcaaaaactatgtatataaaattaattgcttagcttcagaggatgatatagaaccaatgtattatcttaaaaacaggtaaagggctagaatcagacatttattttgcctttcttatataaactgtgccactatccaaacaaatagaagatgaaagcagcatctctttatgcaaggtatttcaactaataattgaaaaccaaatgatggaaatagaacatcacccttttgcaatctgcaatgatttaacgaattgaggcaaggagcgtcaatgtcttctaacatcagaaaaagacaaacagccaggaattataggtcaataaaatcaaacttgagtctgatcaagtccctggatttagctgccaattttcaggaaatacagaagacaaaagagcatgttgagcttcactatgaggattcaaaacaaaaaacaaaaattcagactgcaggacactttgtgttaaatgccctaagtttttcaacagataaactataaggcaaagaatgaaatggaggataagtccatagattaaaagacatacaaattttttaaatagacaaaaacaattagagtgtctaataatgcacacaagtgatgaaaccataaagaaggaagcaacccagcttgagcaacatagtaagaccagcatctctacaaaaaaagaaaaagttagccaggtgtggtggcacacacctgtagtctcagttactcggggggctgaggtgggagggtcgcttgagccctggaggttgaggatgcagtgagccgtgattgcaccactgcactccagcctgggcaacagagtgagaccctgccaaaaaaaaaaaaaaacttggatagaagttacatggttaattttcaaaagaaggacaggtgtgattgggaaaggtcacctggagaagctactagaatggctggcaaaactatattttggcctgggtggaagttgaaagtgtttaacttcaataattcaaagccagacaattattttgtgtggtttttctcgatatgtattttatttcacaataaaaaagaaaaatatataagccttgcatgatggttgatactgagtatcaacttgattggatacaaagtattgatcctggctgtgtctgtgagggtgctgccaaaggagattaacatttgagtcagtgggctgggaaaggcagacccacccttaacctgggtgggcacaatctaatcagctgccagcatggctataatataagcaggcagaaaaatgtgaaaagagagactagcctagcctcccagcctacatgtttctcccgtgctggatgcttcctgccctcaaacatcaaactccaggttcttcagttttggaactcatactggctctccttgctcttcagcctgcagatggcctactgtgggaccttgtgatcatgtgagttaataattaaagaacccctctttacatatatatatgtactatgtaagtcaccatgtaacctgaactgcctatcatgaactgggtgctttctgacccatctagccataaagtaggtggtgcatagcagcattccatcatcaaatggaagtggtatatacgtcatcgggctcgagcaggtcctgaaggcacaagtaagttacatgaggaagtggctcaaatgcccatggtgtccactcctgccaccctgccttctctcccctagcctggaccaatggcctcatggggagttccctatgaccagttgacagaggaagagaagaccagggcctggttcatagatggttctgcacgatatgcaggcaccacttgaaagtggatagctgcagcactacagcccctttctaggacatccctgaaggacagcggtgaagggaaatcttcccagtgggcagaactttgagcagtgtgcctggttgtgcactttgtttggaaggaaaaatggccggatacgtgattatatactgattcatgggctgtagccaatggtttggctgggtggtcagtgacttggaagaagcatgattggaaaattggtgacaaagaaattcggggaagacgtatgtggatgcacctctctaagtggtcaaaagcaagatatttgtatccaatgtgagtgctcatcaacaggtgacctcagcagaggaggattttaataatcaagtgaataggatgacccattctgtggacaccactcagcttctttccccagccacccgtgctgtcacccaataggcccatgaacaaagtggccatggtggtagggatggaggttatgaatgggctcagtaacatggacttctactcaccaaggctgacctggctacggccactgatgtgtgctcaattttccagcagcagagaccaacactgagccctcaatatggcaccattcctgggggtgatcagccagctacctggtggcaggttgattatactcgacttcttccatcatggaaaggacagaggtttgtcctcactggaatagacacttactctggatatgggtttgcctatcctgcatgcaatgcttctgccaagactaccatctgtggactcacagaatgccttatccactgtgatgatattccacacagcattgcctctgatcaaggcactcactttaccgctaaagaaatgtggcagtggcttcatgctcatggaattcgctggtcttaccatgttctccatcatcctgaagcagccagattaatagaacagtggaatggcctgttgaagccacaattacaacaccaactaagttacaatacttcacagggctggggcaaagttctccagaaggtcacgtgtgctctaaatcagcatccaatatatggtactgtttctcccatagccaggattcacgggtccaggattcaaggggtggaagtggaagtggcaccactcaccaacacccatagtgatccactagcaacatttttgcttcctgttctcacgacattatgttctgctagcccagaggtcttatttccagaggcaggaatgctgccacagggagacacaacaacgatcccattaaactggaagttaagattgccacctcgacactttgggctcctcctacctttaagtcaacaggctaagaagggagttgcagtgttggctggggtgattgacctggactatcaagatgaaatcagtctactactccacacagaagtcaggaagagtatgcattgaatacaggaaatccattagggcatctcttagtattatcatgctctgtgattaaggtcaatgggaaactacaacagcccaatccaggcaggaccacaaatgacccagactcttcaggaatgaaagtctgggtcactccaccaggaaaaaaaaaaccatgacctgctgaggtgcttgctgaaggcaaagtgaatacataatggggtagtagaagaaggtagtaatcaataccagctacaaacacatgaccagttgcagaaacaaggacagtaattgttttatgtatctcctatttcctccttcttttgttaaaagcatgtttgtgcatgtatacacttgtactaagaaaatatcttcattttattactttctcctttatcatgtgacataagatttattgacttcacatcagcatttaagtatggttaactttatataatagtatttgggttgaggattggtgcgtttccagttgtacgaaggatagttgtattatattaggtgtaataatgaacttattttcgtttttatttgaagattatgtatggtctcaggagatgtgtatgggttcaagttgacaaggggtggacttgtgatggttaatactaagtgtcaacttgattggatgcaaagtattgatcccgggtgtgtctttgagggtgctgccaaaggagattaacatttgagtcagtgggctgggaaaggcagacccaccctcaatctgggtgggcacaatctaatcagctgccagcgtggctagaatacaagcaggtagaagactaaactggcttagcctcccggcctaagtcttcctcctttgctggatgctttctgccctcaaacatcgaactctaagttcttcagttttgcaactaggactgtctctctttgctcctcagcctgcagatgacctattgtgggaccttgtgatcatgtgagttaatacttagtaaacttccctttatgtgtatatatcttccattagttctgtccctctagagaaccctgactaataaacctgtaatttaaaacaaaatcctggcgaggcgtgatagctcacacctgtaatgccagcactttgggaggccaaggtgggaggatcaagaggtcaggagatcgagaccatcctggccaatatagtgaaaccccatctctactaaaaatacaaaaattagctgggcatggtggcgcatacctgtaatcccagctacttgggaggctgaggcaggagaattgcttaaaccagggagtcagaggttgcagtgggccaagatcacatcactgtactccagcctggcaacaaagcgagactctgtctcatcactcacgtggaaaacaccacagaggctcagagcagtgttttctccatgtaatttactgtgtgatacctttctcctaaatgaggggttgtaagtagaacttgggtttttaattcctttcatacccccaaagtatacacctgaaattggctctgtgattagttatctcattctcagtcacatatcagctttgctggcaactaatattattatacaaatattttacagaaattctggctaaaagctatatatagtttctggctacagattttgacaataccctgacttcctagcttctattcttgtctccttgcaaccaaaatgattgtttttaaaaaacaaatgaaaacactatgagcactttaggaaaagacttcctaatttctcacaaaatgaaacatattcaatgacccgtcaatttcactcccagatatttacccaagagaaaaaatagtatacacttacacaaagatttgtacaagaatgttgagcacagctttattcataaactacagacagcccaaatgtcaatagaatacataaactgtggtatatttatataataataatagtactccacaataaaaagtaataaagtactgatacatgcaacaacatggatgaatttttaaaatattatgttgactgcaaaacactttatcaataaagtacataccatattaatatatttatatgaaattctacaacaagctgcactaaccaatgatgaaaaacaatcagtatactggttgcctctgaggcagtgagtacagagattgactggcaatggtcacaaggaaacttcctaaggtgaaggtaatggactgtatttttatggaagtttgagttgcagaggtggaaatatttgtcaaaagtcagcaatttaagcatttcattttatgtaaatttttaatcaaaatgaaagaacacaggccaggtgtggtggctcacacctgtaatcccagcactttggaaggccaaggtgtgagaatcgcttgagcccaggaattgagaccagcctgggcaacatggcaaaactgtctacaaaaaatacaaacattagctgggcatggtggtgcgtgcttgtgatcccagctactcaggaggctgaggtgggaagatcgcccgaactcaggaggttgaggctgcagtgagctgagattgcaccactgcactccagcctgggcgacagagtgagaccctgtcaaaaaaagaaagaacccaaaactctaggtaatgatctacatactgaagtatttaggagtaaatatactggagtctgtatattattttgaaataggtcaatcaatctgaccgattaatggatagttagaggaattaacaaatgaatagatatgtgataagacaggttttgtaaaatattaacagtaacattggtgagcatacaagtgttcactgtaaaaattctttccactttgttgtatgcttaaaattactgtaataaaaatgttgggcaggaggagcaaatgagatcatatccttccatatttagaaacctacggacacttcccatttcattcagaaaaacaaaacaggaactccttctgcctgtaaggacctatgtaactgggccctatctatctctttactctcattccatatcactctgctactttgtcattctttcccaatgaccttggctttctgtgtgtccttcaagtataaccaagtttgtttctcctcaaaatgcctacataggtgttgcttctacctgggatgctccttctcccagatcttctcattactgctctcttttggttccctcttggctcacctgtaacctcctcagaggccttcccttatcaactaatcaagactaacacacaaatgtccccacattcatgctgtcacttttgcctgatttgtgttccacataccatttatcttcactggaattatttatccatttgtgaacttcctcactttagaattcttcccaatacatattatataatatccccaaggaaatttagcaagctgctgacataactgatcacctgaggagtacaaccagtatgaaagaaaaaaatcaaatggaaaataatataccacatgaagaatttgaagtcagaacagtaaatatcctcaacgaaatacagagggtataagtaatatgaaccgggataaagatgtcctaaaagttgaagaaatattataattgaactaaaacaataaattgggtaaataggatatactactaattaataaatcaataatctggaagaaaagttgaaggaactcctccagaaagtatcagaaaagggcgatgggactgaaaatttaaaaaaataagacaaaacaaaactaagggatataaagaatagaagtataaatgccaacatcttgaaaataagactttcagaaagagagaaaatagcaatttgaggtgaagaattatttcccttgtggagaaacttaagactctatgagaagacattttaaatgaataattaaagtgatatctcatgttcttgaatggggcaacttaattttataaagttatcaatgctcagcaaattaatctacaattttgaaatgatgccaatagaaattctagtgagatcttattaggaacgtgatgaaataatcctaaaattgatacagaagaataaatgcccataaatagctaaaacaacttaaaaaaaaaagagcaaggagaactttctttctggatactaaaatatgtaatagtgtaagaaaacacactataatagtgcaggaatagaaagtagaacaatgtatcagagtagacaactcagaagatcattgcatacatgaaaatttactacttgatgaaaaaggcacaaatcaatgaggataataaagactgctgcagtcaatatcaatggaaaactaagtcactatatggacaaaaggcctaacaccacataaacatgggatcacagatgcattgaagacccaggactgaaagataaaacgacatattttagagagctggagtaggacaatatttgtaattcttagacaaaaatcccaatagtacaaattataaggtaaaatttgatgaatttgattggatgaaaaataaatatgtctttccagtaagtgacattgtaaataaagtaagcaaataaatagcagattgaaagaagtatgtgcaatttgtaaaattgataaggatctaatatctaaaatacacatgaattctttaaaaacaaaaagacacagtttagttatgaacaaaagaaaccaaactcattggtagttagagaaattaaatttaaaacaaggattgtcactttaccaagaattgtcaaaaattagcaagcaggttaccgccatattttgacacggatgtagtaatataagcacccccatgctcggctggcagtagtgcaaacttgtgctgcctttctggagagaaattgcacaatcatacaagtacatagggaacatatacaagaatgctcgtcacagtattgccattttaaaaaattgaagacaatctcactgtcttccaccaggtgaacaggtaagtacaatgtgatagatgcccagtaaaaaatattccatgatatttagaaggatcatgctgtttctacacacagttacaggggtagagcttacatcaagaagctgagctttaaaaaaataaaggatgaatgagatagagtctataggataatcacattttttaaaacaaacaaataaatggatcaagtccatacataactattgcagggcctgagccaaagaatgtaaatggaggttcacatgtatctatagatttaaaagtgataaatcaagctgaaagattattaaatgcaatattttatctttttatttcacaaaatatcttcctaatgataaaattggaaaacatacataaagatatgtttatatatgtatgatgaaaagttggcaaaatattagagattagactggacttaatcattatcgcacacatctggatgttctgtcaatgggccaacaatgtttggctgagtaattatttaatattacaaactatttctgagctaccatgtgcagctgttgtaaacaacatgctaattcacaaatctaagccacaatttgaagagaaatcaaggaaatattcaccactggaaataatacttcatttagccacagtctataacattcatactatctcagagcaaagatttaacaaggtaatttgtcttttctcttacctgtgtttccactgttcaaatcctccctgtacttcagacgttatctgccctaatgctgccaacagcacacgcaccgcctttcagtgcatttgaactgagaggatacgagcgagagataccgagaagtactttcctggggactcaatgaagagtcagaagagtgaatattgagggctacaaattatgttgtgccagccatgaacactggaaggtgagtgatagagtttcccaggtattctataatacattcttgtttttgtaatattcagaaccctctaacatggggtctaagtcaagagccaaaggtcaaaggatgacaacagtaggatacatgctaaatatattaatagagctcctatgggaagaagctgaacaaaattatggaatgcggttaaaatggatgaagaaaggaaggaaggaaggaaggaaaaagaaaaaaaaaaagaaaagaacctaatagaataatgaggatggtatgccattgaaccaaaaagtattatttattaactcaaccttctctatctgtggccaaacaaaagagaaaagggtaaagaattaaccaagtaggtagctctgtggctcaatggatagctcattgcacttacagtgatgaaaaaaatgaaccaagtattatttgcatttccagtatttcttggtagcattttttcgaacaaaattccaagagatcacaatatgataaccttcctatttgatttgtgcagtattatgtaaatcttgccatttttgcaaaaatatatatgagtgcttcattagttttccttagtacatatcttaatactttgatattcaaatcaatctctctctctctgtttttgttttgttttgttttgttttgttttgttttgttttttgtgggacagagtctcactctattgcccaggctggagtgcaatggcaccatctcggatcactgcaacctcctcctaccggcttcaagcgattctcctgcctcagcctcccaattagctgggattacaggtgcacaccactgatcccggctaatttttgtatttttagtacagacaaggtttcaccatgttggccagactagtctcgaactgctgacctcaggtgatcagcccgtctcggcctcccaaagtgctggagttacaggcgtgagccactgcgcccagccacaagtcaatctcttgaagtactgtgtactccatcatctgggtagattttcattgtcttctattgttaactggtttaattatgcctaatgtactttttgcaataaagagttgagaagttcaacattgtgttcagtgactgcataaatccatgtttttgtgagatttagaatttcactttgcaattagtttgtattttattgtgacatccaaaaatcgggaagagctgatggagaaggcacaagacagtcagcaaaaatccctagtggtgctaaaggggaaggaagcataagtggagattaatctcgtatgtagaagttcattagtaaatatattcatgtcatacagactttcggttccttattgcaaatttatgatttgggaactcccttaatgaaatttgggagcaagcaagaactccctgtatggttatctcaacttcctttagtgattattattaaaacagattgacccagttgtcagaatgttgaattgtgactctccttgagctacaaatatggatatcctttaatacatgtatcttttattatcaaatatagtaattgcaactcttttccaatattgctagatctgacaatgagaacagttatggtattttaagtaagattgtcacagaaaacactgaaggaagaatttcatagaacaacacaacttagaagagcagccagatatataactggggctgactgggaaggggatcatattgacagcataatcaaagggaagactatcatttaacctgttcagaaacatggatccaggctgttagcagcataaacaaatgaaaataaaaggaatgtatactagaaccacaaaaattaagcaaccaagcaaacaaacaaataaaattctactaatttatagttttcaatattttttaaaatctttgaacccataaaacctgtaccaaaattctttgccttaccttggcattcaagttctactgacccattgtattttactcacatgtttagaaattttctactaggccaggcgcagtggctaatgcctataatccccgcattttgggaggccgaggggggcagattacctgaggtcaggagttcaagaccagcctgatccacatggagaaaccccatctctactaaaaatgcaaaaattagaccggcgtggtggtgcatacctgtaatcccagcttctcgggaggctgaggcagaagaatcacttgaacccaggaggtggaggttgcggtgagctgagatcgtgccattgcatgccagcctgggcaacaaaagcaaaactctgcctcaaaaaaaaaaataaaaataaaaataaaaatcctactactaaaattatttaccagctgactcaattatttaggagctgactattcaaatggtcagttggatttcttgagctttttttactcttcttctcttttattgtatgttgggcaattctgtcctgaatttcagtaagatacaaagaagcagaaagattaattactcagtttcaggaagtctagtaaaagttttgtgagaacaaaagtgtatgctatcctcttagccagcattctccaaagaaacagaaccaacaggatgtgcaaagagagagtgagagaaacagagagagatttaagtaattggctcacacagttgtggaggctggcaagaccaaaatctgtagggcaggccaattccctggagacccagggaattgcagtttaagtctgaaggcaatgtactggctgactttccacttctttaggggtcagtgacaggggtcaaggggagtaatcttttcttttatggacttcaacggtttggatgaggttcacccacattatggagggtaatctgctttactctgtcagagtctactaattaaactgttaatctcatctaaaatatgtctttatggaaacatctagaataatgtttgaccaagtatctgagtacagtgacctagccaagttgacacaaaacatttatcatcacagctatccaataaaatttagtgaaatttagtactgtttggaagggcaaaggaatttatctctagagtcagttacagttcagtagaaatccattactcccaaacctctctgtgaccttagacactaagctaataataatttcttgacctctaaatatgggaataaatctttctttacttcctaggattattgtgagcattaaatgatttaatcaatattgtttaacacatcctagatgctcaataaatattacctgattattattttattattattttaaagcatattgagcttttttaacctccatattttataattgagttatgaaacagataattgtaagataaatgtatattttatattttctcctcaaataatatcagcaaattagcatgcattctttactaaaagaaatatcagaatgtatcaaactgtctcataagttggctgcccagttgtctaggcattcttattgtaaaagtaacatacggttattactgaaaaataagaaaatacaggtaaacataaaacacaaaataataaatctctctttctacacacacacacacacacacacacacacacacaacacacatacacacacaccagaatattgaattggaagctgcaactgaaaatccaagatacaagagataacagacataaaactgagttttgaggcagacactaagatacaaatttcaaaagaactattcaagaagtacatgcataacactttcttactggattgaaaggagaagagtttgagagaaatttatgagatttctttggtgatagctcttcagataagaggtcacagtaagcccgcaagtgaaggctggggccctgcatcactcactctgcctttaggcatattaaaggcccaaaagtaattatggtccttaattaaatcctcaataccaaatccctggatttagtaccttctttaattgaatagcatgcctgggccagactaatatatggtaacagcccacagtgacagctatacagacattcatcattttgtgagtgcagcctctgtagtctctaatccccatgacggtaaatcactaactctctgatgtaggatttcgtttttgttcagtgtgctttatttgtttttgtttttgcagtggtggtgcaatgtggggaagagagggagctattacaccaaactcttcttcccttgatttagtagggctgaaagaccactgacaagatttagggctgtgacccacattcatgtgctagggattaacaggtaagtgtgtatgacagtttgtgctgcacaaaactcaactgtcagtctggccatctttgccagctcatgcattatttttccattctgtaacatgagaatagatgtagtctcctgctcaaagaaaagaaaggaggctggtgtctttattgaaatctcctctaggaaggttcagcttctaattcactccatagcataaattcctggaatatatttgcagtacatgtaactactcaagagcctaaaaccagggctcattatgtgacttgcctttctttgattgttgattattttttctttctagtttgaagctgtagttgaaagttctcttcaaagagaatatcagtcaatacataacctcagatctatcagagctagactgattctcagagctgatggattagacagatatggttgaaggcctttcagagatgagatgaacctcatcattactggagtgctaagtcacccagtgaccctcaagaatattgctttattaccacttcctaggaagtatgtccttttgtcaaatcaaaaatcttgccacaccacaagactctagcctacaagatgaaacttttatctcacagcagcctgttaagtccttgtcctgcaacactcagcttattctggactccctaattgtggggattttcacatcagccactttctgctttctgcttcctcttgaaccccactgagaaggctcctggcgtgccttgttgtgtgctgaacatggtgccacagattccaatgtaagtgtgtatctttccctaacctcccaattttttggcctacccttatatctatgccaacagcacaataaaaaatggaaccctattttcccttacatcgatgaaaattaaatgatccacagctaaacatctgtttcatgattaatcattatggtactatcatcatgtgcatttaacatccctccttcctgcaccacacatgcacacacacgtgcacacaggatttagagctggaaataactctgatatgggcaggcatttgtcacttggggtaaagggcaagggaactaacatttttaaaatgcttacaagacagagtagcatcatgagtcctgtggtgcagtggaacaagaacaggctgtcaagtacaaccggtgtagtttgaatcctggcttagccactcactctttatgacttcaggcatattacttaccttctttgtacctcacttcttcctctcttacatgggaaaatagttcatgctttataaggtaaggagataaaaaataatgaacatgcaacatgtagcgcatgatcaaaaaaacatagctattataattgtctccacttttcagaataggaaattgaggcttaaaagaatgtaaacaaaggccacacaatttcttaatttaaaatatagtcattcacacatgcacacatattttatagcagcacaatttgcaactgcaaagataggaaaccaatcaaaatatccatcaaccaatgagtggataaagaacatgcaatatacacacaatatgtaatactgcctagccataaaaaggaatgtcttttgcagcaacttggatggagttggagaccattattctaagtgaagtaagtcaggaatggaaaaccaaatatcatatgttctcacttataagtgggagctaagctatgaggatgcaaaagcataagactgatataatgtactttggggacatggaggggaagggtgggaatggagtgagggatgaaagactacatattgggtgcagtgcacactgtttgggtgacaggtgcaccaaaatctcagaaatctccactaaagaacttattcatgtaaccaaaaactacctgtaccccaaaaactattgaaataaaaattaaaattaaaagaaaattctgatgtctttctctctatatatatgtgtatatatatgtatacatatataaatactatatatgtgtatctatgtatatatgtatacatatgtatacatatataaatacatatatatagtcattttatatatatatagtcattcaacgttcagtcaccttttgattgagatatatgtgcttgatactgatgaatatgcatgtgtttgtttctccaagcaagatttttcaaataaagtgtttcaaaggacaggccataggctggggaaaattctgcatgcctcccacttctcagcagtttcctttattctcctccctcctcatgccaaaacaccctacatatgtatatacatatgtatacatatgtatacatatataaatactatatatgtgtatctatgtatatatgtatacatatgtatacatatataaatacatatgtgtattatatgtatataaacacatatatgtatatacacatatataaacacacatatatgtatatatacacatatataaacacacatatatgtatatatacacatatataaacacacatatatgtatatatacacatatataaacacacatacatgtatatatacacatatataaacacacatatatgtatatatacacataaacacacatatatgtatacatacacatataaagacacacatatgtatatataaacacacatatatgtatatgtacatgtataaacacatatatgtatatgtacacacataagcacatatatgtatatgtacacacataagcacatatatatgtatatgtgcatacataagcacatatatatgtatatgtgcatacataaacacatatatgtatatgtgcatacataaacacatatatgtatatgtgcatacataaacacatatatgtatatgtgcatacataaacacatatatgtatatgtgcatacataaacacatatatgtatatgtgcatacataaacacatatatgtatatgtgcatacataaacacatatatatgtatatgtgcatatataaacacatatctgtatatgtacgcatgtatgtatgtgcatatacacatatatgtatgtatgtgcatatacacatatatgtatgtatgtgcatatacacatatatgtatgtatgtgcatatacacatatatgtatgtatgtgcatatacacatatatgtatgtatgtgcatatacacatatatgtatgtatgtgcatatacacatatgtgtatgtatgtgcatatacacatatgtgtatgtatgtgcatatacacatatgtgtatgtatgtgcatatacacatatatgtatgtatgtgcatatacacatatatgtgtgtttatgtgcatatacacatatatgtgtgtttatgtgcatatacacatatatgtgtgtttatgtgcatatacacatatatgtgtgtttatgtgcatatacacatatatgtatgtatgtgcatatacacatatatgtatgtatgtgcatatacacatatatgtatgtatgtgcatatacacatatatgtgtgtttatgtgcatatacacatatatgtgtgtttatgtgcatatacacatatatgtgtgtttatgtgcatatacacatatatgtatgtatgtgcatatacacatatatgtatgtatgtgcatatacacatatatgtatgtatgtgcatatacacatatatgtatctatgtgcatatacacatatatgtatctatgtgcatatacacatatatgtatctatgtgcatatacacatatatgtatgtatgtgcatatacacatatatgtatgtatgtgcatatgcacatatatgtatgtatgtgcatatgcacatatatgtatgtatgtgcatatgcacatattgtatatacacatacatatacgtgtatatctctatatatacatatatatgtatacataggtaactgaacgtacaggtatgaacctgtaccccaaaaactattgaaattaaaattaaaatcaaaagaaaattctgatatctctctctatatatgtgtacatatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtacgtgtatacatatatacacacctatatatgtgtacgtgtatacatatatacacacatatatatgtgtccacatatatgtgtgtgtacatatatacacacacatatatatgtgtatacatagatacacacatatatacatatacatacatatatatctctatatatgtatacataggtaactgaacgttgaatgactatatatactatatatagtcattacgtatatatacactgtatatagtcattatatatatacactatatatagtcattatatatatatgcactatatatatagtcattttatatatatatagtcattcaacgttcagtcaccttttgattgagatatatgtgcttgatagtgatgaatatgcatgtgtttgtttctccaagcaagatttttcaaataaagtgtttcaaaggacaggccataggctggggaaaattctgcatgcctcccacttctcagcagtttcctttattctcctccctcctcatgccaaaacaccctctcagatgcaaattttgtaacccaatcattactgcaggactttgctgtaagctacctgtcaattaaatttccctggagtctctcaaaccactctacattgcctattttaaatctatcagtggatgtggataaggataaatattgtccatagggaaaaaaaaaaagcacacacacaaataaaagaatgaactatacctaacagtgggataggggaaggagagataaagcttcgaagtcactattaacagttcagatcatctttgaacaaaatagcatttactgaaagtcttttgatagaaatatttcctatcctttcataaatttgttctttcttgttaggtgtttcctttttcctttttttctttttgttttaccaattccactattgagaaacttattagatgtttactgaaaagggctggaccattttcggaacttgtgcaaccttcaaaattcttagtttattcaatatgtagagcttccactattgcttaactgccacacccttttcaaattccttagaaacttgtaaatctgaaaccaatcagagatggttaattcatttcatacagtcccaaatgccaaaatacatttttttcatggaaaattcaagctattcccagatgtcaaccataaacatgcattttcctccccttttcttcactgtttgggtcataaaactagtgccacattcacagtaaggaagcaatggctctaattttaatctttcatcttgttttaggctaaactggaggtcagctttaaagggtatatttgttctagtcagccaactttattgagccctaactatgcagtaggcattggggaaagtggatgaataaacccagtttctactctcaaggatttcagtctattaatggaaacacattcatagacaaataattattaacagtgagaatcatttctacagatacaaaggaaaagattaagcctatgtagctttttgtggcagaggtagatatcaggaaaggaactagagaaagttggaagtgtgaacaccatatgcccaataactattgaatggatgagcaaattgtggtacatccacacagtagcatacctgacaacagtaagaatgaactactgatacaggcaacatcatggatgaatctcaaaaacattatgctcgctggacacagtggctcatgcctgtaatcccagcacattgggaggctgaggagggaggattgcttaagtccaggagttagacaccagacagggcactatagtgagaacatttctctacaaaaaattagccaagttagtggtgcatgcctgtagtcccagctattcaggaggctgaggtgaaaggatcacttgagcctgggaggcagaggttgccatgagccaagatcaggccactgcactccagcctgggcaacagattgagactctgtctcaaaaacaaaatacagaaacattatgctaagtgcagtatgctggatgtagaagactacataatgaataattcaatttatatgaaattattttaaagacacaactatagtgacagaaaacaaatcagcagatgttggggccgggggcaggaggaggggatagactgcaaggtgacataggaacatttttgcagagtaatgttctagattacaattgtagtgcttatatgactatataagtctgtcaaaagccattgaattgtacatactcttaaaaattggtaaaatttatcatatatattgcattgtattatgccttaataaagctgacttttaaaaatgaatgagtccaattttgctatatatacacagggcataggaaaggcaggaagaggtttctggaggagactgcagatagagacaaccaaagacagggaaacataaaacaacatcagggagaagaaggggttataagtggttcattatttctggagccgaagtgaaagagtgaggaggactgagaccagaattagattatggaagactttatggccattctcatcttcctgtaaaaagtgtagctttggccttcaacaggaaacagcaaaaagagaaaaacacactctcctaatcgatgacaatatgagatgctcttgaggtagcttaagtcagatatttacctggaataaataaatataattatttacattgtaaaatctaaagtgctagcaagattatttctcagcaatgatgttggctcccaagagcactccagaaaatattctattttgaattagaggcaaattcactctaccaaaatttagcaatgtcctgactatacactagccccacaaagtggtcatttgccccctagccaagccaaattaaaagtttgtgacacttttacaactaaataatttgaaaaagtgaattatccatgattagtagaaaaaaatgaaaatagtgttttacctaagcatgagagaataggacaaaataagaaaagtagattaggacataaaaagaagctaaaatgaataattttgtaagaaaataacctgcctcaaccacagcttttgtcaaagggcttccctcagttaatcgatatctgagtctacctatcttgagagaaagtggctcttttgccctctattacaagagctgacccaaagagactcagggtcagggcttgtcctatactctgggccaggtcacaataaccaaccctcaccccaatacacacacacacacacacacacacacacttttttggtgtacataccttgcccatgtgcttcaccagacatgcctcctgcttcctcctctagctccagaaagcctgtgtgtaagctctggcatctgtctcctcacaggaaagaaaaccacttgaaagacattataggagcctcattttactttctgggaaattaatataaaagatccataggttttagagatagactccaatttggagatggatgcagtaataaaaacaacaaaagatcacacaaatgtcacttgtcttcacagttaatacttcctcctctccctctcctcccttccactctctctgtctctctctccctccctgccccctcctcttttgcttgcatagctccttcactttatacccatgcagatagagttgcccaaatcagcaaagcaactgtatctgaagtatcatgggatagatctacctccatgtcaatatgcagattgtcttgtcttacccttcacactggaagaatgatgatgatattaatattagtaattataacaataatatttccactcattaaacaactacaactcaccaggcagtcaacattgctagtccttataatcacctgcagagcagatgctgcaattatctttttacagatgaagcactgagactcatagagataaaataaggtgcccaaggtccagtaaggtgatagttgcagaatgaagattgaaacgttgatcagtctaactccaaatcttatactttttccataaaacactgatgaaaagtaaggtgagaaggaaggaaagaacaagaagtctgttctgtgtccagacatattcaggaccacatagctccaaagttagagaagcaagtgctgatgaacaagacttcagaaaaatatctatgttctattcatattccaccagtattaaacctggccactggagaagacagtgtggcgattcctcaaggatctagaactagaaataccatatgacccagccatcccattactggatatatacccaaaggattataaatcatgctgctataaagacacatgcacgcatatgtttattgtggcactattcacaatagcaaagacttggaaccgacccaaatgtccatcaatgatagactggattaagaaaatgtgacacatacacactatgcagccataaaaaaggatgagttcacgtcctttgtagggacatgggtgaagctggaaaccatcatttttagcaaactatcacaaggacaaaaaaacaaacaccgcacgttctcactcacaggtgggaattgaaccatgagaacacttggacacaggaaggggaacatcacacactggggcctgtcatggggtggggggagggggagggatagcattaggagatataactaatgtaaatgacgagttaatgggtgcagcacaccaacatggttcatgtatacatatgttaacaaacctgcacgttgtgcacatgtaccatagaacttaaaatacaataaataaattttaaaaagaaaaaataaaagaaaaaatcttatccagtaaaaaaataataataaaataaaaataaaataaaaaaataaacctggccactgggggagtaaagacttcacccattgtattagtctattctcttgctgctatgaagaaatacccaagactgggtaatttataaagaaaagaggtttaattgactcacagttccacatggctggggaggcctcaggaaacttacaatcatggcagaaggcacctcttcacagggtggtaggagacagaatgagtgtcaaatgaaggggaaagctccttataaaaccatcagatctcatgagaactcactcactatcacaagaacggcatgggggaaactgaccccgtgattcaattttctccccctggtcgtgcctttgacatgtggggattatcaaaattcaaggtgagatttgggtggggacacagagccaaaccatatcacccatccaccagtcaacaattatgataaggaaaataatagctccaccaaggaggtgatatttaatccaagtctcaaaaataagttggcatttaccagagtaggggattgaacattatttcagatacagcactttcagttactaaagcatttcctaaatattatggtgtttaatactaagaaaaagagtgtgagataggtgggactgttatcgatatgttcattttaaagattagaaggtttaggatactgatgatcagataggctgatcttataccacatcacacatccaggcaatagtatacatggaaacacattggagaggaaaactggtttttgtaggaattgggttttaaattttaaggcagaaaaagaggtatttgcagagcacttttaagcttctgtgcaattccccctaatttaacacagtaataagttttagctcaaaggctttttgaaggaataataattttgaaaatcttccctattttcttctaccttttaaggatgtagggtaaaaatgctctcccaaaatataagtgtgcttgaatgtgatccatcctgtcagcaaaggcaggagtaatcataatgtaaagatagatttttgcgtatggcttatgccaatgtttgtatttgatgaggatgtctgacaggcagatcatatgcaaatatttgagctgaccgcctagaaatgagggaactgggaaagcaaagatgaaaagaaggagtttaaagaaagtggagcaagttgtagcatgtttggtgcaatttgaagggagcgccagcactgctttaattgagttcatgcaaatcatttaacaaacaaacaatacccaggacatgggaggcaggatcagcttcaggaaaacttttctgttgagtcagaaaagatatgagagagaaatgcagcagcacacagagcagatagaaccagagtaccaagtcaagtttaggaattgttgaggccaaaggaagctgcagagtggaccaccaagacagagctgataggattacaggaagctaagacatgtctttttgaatggaaaaataataataaatatttttttcaagagagcaaaatggcttttattggacattattgtgtttcagacactgccttatatgctttatattactcattatgtttacaacaatccctttaagttaggtgttactgtctttattgcatagataaggaaactaatgatgataaagttgagtgacttgctcaaagtcacactactggttgagagccagctgagtttcaaacacagtcttctggctctgttgcccaagtgctcagtcactctcctctctttctcactcttggaaccttgacttgtgcactaaaatatgtccaactttctccagatcttctagtatgctgtctgctatggactgaattatgtccctccaaattcataggttgaagtcctaagccctatgactgtgtttggggctttaaggtggtaattaaggttaaatgaggtcataagagtgaggccctaatccagtaggactgggacccttagaagagtgaaagagacactagagatgatgggatgattgcacatgtgaggacacagtgagatgacagccatttatcagctgcggagagagacctcaccagaaaccaactctgctgaagccttgatcttgaacttccagcctctaaactgtaaggaaataaagttctgttcttgaagcatccagtctatggtattttgctatggcatccctagccaactaatgtactgtctagcagtaacaaaggccagcctaggttatggagaatcaaatcaatacagatatattacctgaaatatgaaatgcacgatgatacttggctctgcacctggggtattgtgctagacctggagttatactataactttggaaggtaactggtgaggaaaatggaatgatagtttagttattaaacttatatctattgagttctctcaatgagccagatgtgaggaatctagtgtataattggacaagatatacatgtaaacaaataaatgtgatgccaaatgaagtgaactctataaaggcatagtggatagaaagtggaattggaaccaggttaattcgtgttcagattcaaggacttctaacattatgaaatggggaaaattgcctagtcttcctttccaagcctgcattttctcatctataaaatgagtttaggctgagggctgagcacagtagctcatatctgtaatcccggcattttggtaggtcaaggtgggagaatagcttgaggcctggagtttgagaccagcctggggaacaaagaccccctctctaccaaaaagaaaaagatttttttttcaagcagctgcgatatggtagtgagcacctgtagtcccagcctcaggaggctagggtgagttgattgtttgagcccaggaggttgaggctgcagtgaggtgagctatgatcatgccactgcactccagtgggagcaacagagtgataccccatctcaaaaaaattaaaaacaaaaataaaagaaagtgagtttaacacatacacaccccataaaaccactgcgagattaaatgacctattgtaagtaaagtaaatttaaagtacatggcacgtggtaggtgctcaataaagtgtatatagagtcatcattgtaattatctatgagatctagtgggggcaagcataaaaggattatcttctctatatagaaatatcaaaggaagacttcccagagaaagtaataatctgagtttttaaaaatgagtagtttatccggctgatagagaaaaatgtatttgaaagtgcagttcgggtacagaaaacagcatgggtaaagataaaaagacataaaaccaaattgcaagttagagcactatatttaattcaacatggttgacctagaaatggaaggaatagtgaattaggatatggtaaacactgtttatcacaaagacccaaaatagcagtggcttaaatctgatagtttattcttctttcacatgaacgtttgagcagctacggttcctcttctctacagaatcatcagagtccttggttccttttatctttgtcttcatccacatagtccaaggtagctcactaccaagtccacattccagtcagcgggaaggaagacagcaaaggatggaatcatcacacttttcaaggacagaagccagaagttgaacatgtgccttctatccatatcctcttaaccaggagttagttacatggacactgtgacctgcaagggagcccagaaaatgtggtatatgccaagatgttattttcccataccaaattcttagttgcagatttttacatttttgttccaacactgccaaaattttaccataagaactcttttatcaatagtatttctaaggaaattgctatgtttaatacaccacagtgtctgccactaattacttattcacccaaaactggcttctcttagtatgactacagttgggctcgctgatctgtgcactcagtaatctgccccatgtgctctcttacctcatgttcactgtgaggagaggaggatctttatctcatttgaactgagggagaagaaaaatttccacatcgggtgtctgagcaacaacgggttccctattgaacagaaacccaatgccaagatattgccaaagtaaccctttcaaattctccctaggtcagaagtttattgtctaatttcatagccatttgatggaagttgcagttaccattttaaatgtataatgtacattagaatagataatttacctgtgtcataattaatttataaactacctggcagagcgaggtggctcacgcctgtaatcccagcactttgggaggccgaggcaggcagatcacaaggtcaagagatcgagatcatcctggccaacatagtgaaaccctgtctctactaaaaatacaaaacttagctgggcgtggtggcacatacctgtaatcacagctatttgggaggctgaggcaggagaatcacttgaacccgggaggcggaggttgcagtgagccgagatcatgccactgcactccagcctggtgacagagtgagagtgcgtctcaaaaaaacaaaaaacaaaaaacaaaaaaaacaaaaactacctgactaaactagaaattaaaaagaaaaaaagtctaatttttcaaagtaagagtgcgtacatattaaatgcatttaatgtcacaagaaaaattttatccataaaaagataaatgacatttcatcaaataaaatcaagaatctgaaaactataaagctaaatatggcaacaactaagttcattatttctttaaaaataatagacaccaaaagtctctttgagttaggacaaaaagtcaattaacaaatgaaataattactataatttaattataatacagaatatctaatgatattgaagtaggtgattaagcctaatagtaataagtaataagaacttgtgccttgtactaggttctaggagtaaaagaaaaaaaaaagtatatgactgtattttcttttttttttttttttaattataagacaatgtattgtagacccagctgcctaactcagtgattctcaatcttcttgcccactagaataaccttgatggttccaaaaaatatataccaatgcccaggtcagacttcagcaccatataaacagactgcctagaagtggagcccagatgcctaggtgattcttatatgcagccctggttgggaactactgcccttactaggctatgagctccttgagggaaaagactgtgtctggtttatccctaagctcatcatagtgcctgacacatatagatactcaaatgttcaataaatgaatggatgagggggtggatgggtggatggatggatggatgcatggatggatagatggatggatagatggttgaaagctagcatttcctgctctcaaggtacttattatcaagtaagaaaaatacaacttaaacacagatagttaagtagacacaagccagtagatgtcgcatgattaccactgtatttcacaacagagattatgatctgaaggaaagcctaattaaatgcttacaagggagaactttcatttataagccaaacaggaaaggcttcaattacactgctgattaacacttaattttaaaagagaaggaaggagtcatcacatagatcttaacacttaaaaggaataaaaataaaaatgctattagcaatgagggaatgcaaagactaaaccttggaagtgaatttttgagtgctgtaagccctgttttaataccaccttctctaggacagaccatgtgtctggttttgttggactggattttgtttggcttggttttatggtaacttttctcccctgttattatttccaggtcaccaggccattctactctctttgaatctacaatcagtgctttcatccagatagatgatccagtatttggatattaatctttccagggcactcagccagaagcattcttacctaactcctccacaccctagtgccacttagcatctaaattgagcccagatcctttggtaccaaacactgctcacaagggactatgcaaattaaatgactccttttgaacaactgggtatttataattaatatacctcccaatgtaaattaaatgaataaatatgttgtggaaacaaattacatttggacaagaatcttttttcaggtcagcttgtatatttatgtctgatgaggaaagagaaaattcttagtttccttggggaggaagttattagaaaaatttgaaatgtttttcagcataaaattacataacgtatccactcaaaaacatctctaacagagtacggcttatcagaaaacaaaaaattatattcaactagacacagtaggcaaataaaattcaggcacagaaattgaaaaaatgatttaaagttagagctaaaccaagatgcaaagattatgcctcatgtttttcaacttttgataagtaatgtaccaaggttctagaggcctctcattctcagaagtaagaccaatctggggagtgttctaactcccctctgattcctgactgataagaaccaaaaaggagggcccgagaccacatatggtaccacctttggtgcagccatcaatgacaacttcccaagcagcagagctgacacctggttcttattctatctctgtcatcacatgtgccaacatttgacccaagcactaaaagaactttgatcaacaacacagcagtattcctcaagtacttgatccttcctcccttccaggaggggaaactttgctggttcccctcctggtttgctgattcaacatctctgttggcctttttcacctcacttcttaagtatttgtttaatattctgtccatttgccttttttacggcctccaaaaaatgagtctccagcatatcttctctcctttttaaggttcagatcaaagtctccaaatgccttctgcttatcttctcttggatattccagtatccaaaacaaaacttgatatcatcttattgtcaaataatctggtcctcttttcccatcttagattcatgatcttaccattccttcagtcttccaggctactgggttgacaaatgttctggattccatcttaaaactgtatctcagaattaacctctgagatatgtccccactttccgtctctttgctcaggctctcattacttctcatccaggctaattcaagagtctgctaactgatcctcctactacttgtcttttccccactgtcacaatcatcctcctgggttttcttcttaaagaacagcaaaatgtaattttgtcacagtcctgcttgtaaatttttgctgactgtcccttgcatacaagattaagtccaaacttggcctggctcggtggctcacgcctgtaatcccaaaactctgggaggcctcggcctgaggtcaggagttttaagatcatcctggccaacatggtgaaaccctgtctctactaaaaatagaaaaattagttgggtgtggtggcacacacctgtaatcctagctactcaggaagctgaggcaggagaattgcttgaaccctgtaggcggaagttgcagtgagctgagattgcaccactgcactccagcctgggagacagagcaagactccatctcaaaaaccaaaatcaacaacaaaagaaaatttaatcagaagggccataccaggcctttctcaatatgacccactttgcttcaccaggtgagctctctgacacgactcaccacactcttaaatgaatttctctctttattccccacaccagctatgcctttcctatattttacatgtgttgtatcttctgtgtaaaatatctgatcttccccactctacctacacctcaacctggaaaacttctatttttttttttatttaaaaaatagatcaaatgtcacctggctagaaagtcttctctaattttctcaaggtttaatccacccacatttgataagaacaagcacgtaattccaagatcctcggaagcatcctgctataaagtatgttccttgcaacagacatgaactgcgtctaactggctcaccactgtatctccagcagctgacatttttcccagcacataatccttgttcagtttatatgtgtttaatgaatttatctcttgctctttagtcattagagcacagagacaaggaacatagttgagacaggaatttggtggaagggggaatgttaggagaagaggaatacagaatcctagtcagtcagtaaactaaaaagtctaagcagacagagaaactgaatttgaagtctatcaaagagacttcctaggagcccacatgaaagagaaggctctaaggctcaggtgtgaacagagagacagtggttaaaaatgccaatccaatatgaaccccaggcaggtagattgtctctctttgaaatcccatgggtcttttacatgtagtgtcttgtattacaatttatttgttcacatgactgaaacacccaacagactgtgagttccttgaagacagccaccttattcctccttatattttgagtacctgttactgtgcccaccacttacccaaggttttactataaatttcttgttccattaaaaacccttaggcataataaatgattgtgcagggactgagtttcactgttagaaccactaatgaaggcagacctggagtcagagaatccaaagtattaatgcgttcagtgagaccatgaaagttcaaatcacatgagacacctgagaaccttgagtttgcttttcacagatttatttttagggcaatgaccctgaactttgtgacccagacctacttctacttggtcccagtaagttttcatcttcagaagagctgagaaatagctcaagctgaataattggccataatttagtcaaggtcttctttgacagtttgttgacatttacagtctctaagagtatgatcctgcctgattagactcagaatacagtcagccccatttttaaaagaccaactcttacacaaaattattggcctattagcttttcagtattactctttgatacaatgcaaatatgagcttctcaggtaaatatttcacacgaggactcttatggagtggccacaaattctttaatcttcctcctttcaagaagtgaagcccatgtgctagaatctgggtgggcttgtggggtgtagaggagaaaatgccatctgatttctaaggtgagctcattaaaaagccatgcagcttctgccttgttcacccttggagctgcctgagccagatagaagaattctgactatcctgagaccaccatgctggagggtgcacaggcagatactccaccgacaatccccactgagctggtcctgcagccatctcagcccaggagggacacgtgagagaagaagctgtcttggaagtaaaactctagctccagtcatccaagtcaccccagccatttgagtcaccccagctgaggtcccagagccacctcacctttccaagttattcactacacctcatttcagacccagatttattataacaagtacttggtgtccataagaaaaaaaaaaaagtccaagtccagctccactgatagtggaggagctgaattcaagacccataggatttgagctgaacttcctgggtctcaggggcactaagatagacaaacccagcagagatgtgggccttgggagtccatctttctgagcattcttatgcaccgatactatctccagcttcattttattcttgattttctttccctctgtcccattttcttcacgttatataaatgaattttcctaagccattttcaatctttttgaaaatcaaagtaaagtataaatacacaaagttatgttaaaaagatgttgaagaaaacagcagtccaatcaatttttgttgaattaactcattcattaaaggtaaaagcaatgataaagtcctatctttctctctattcttaggataggtgctgtcttacttttttttttttactgacaagatgctacagattgaatatttgtgtcccccaaagattcctatgttgaaatcctaaccccaaagtgatggtattaagagtatctagtggtggggcctttggtaggtgattaggtcacgggggctctgccaatttatttatgtgcacaaattaaaagggcacaatagtattagtgcccttataaaagggaccccagagaactccctcactccttccatgatgtaaggacacatcaacacatcaaggagatgcctgtctatatgaaccaggaagcaggccctcatcagataccaaattttctgacaccttgatcttgggcttcccagcctccagaactgtgagaaataaatgtctattgtttataatccacctattctatggtagtttgttatagcagcccaaacataagggataatatcccagaataagggataataataacaaacaacttgttttatttctcagattgatgaatacaatctggaagttggtaaggggtgttcaacttatctgtgatacattggcaacatggaatattaaggaactccataggtaacatgtaattgacctgaagggatgttttgaaggtgtggaaatacaaaaagtaaactataaccttgtgcatatggtgagatccgatttggaaaaaaaataataataacaccagccaaagcacacacatatgcacatgaacatgtagaaatacgtgaaaggattcccaccagattgttagcatttgtcatttggggacccagagatgggaagtgcagggggtaaatgaggtgaaaagattttaatagctcattttgcctttattttcctttatactgtttcacttattgcactaagttcacattactcttgcaatttttgaagagaaattaaagggggaaggttgttattttttttaacgccttagaacatgcattttttcccctctttcccttatcctcccatggtaatgtctattgatctactcttagcatcctacgtgctacagcacatgatttagaatttgaaattcttttcacttttaaataactttattgagatatataatttacatataataaaatctgcctattgtaagtgatttttagtaaatttatagaactgtgcagtcaaacccacaatacaattttaggatatttccatcacctggcaaaattcccttgtggctatttgcagtaaattactcccacatatgcccagagcttctgtctctataaatttgtcttttctaggtatttcattacaatggaattttacaatatgtagtcttttaattctggcttctttcaggaatcataatgtttttgaggtcctccatgttgcagcatgtatcagtaatctgttctttcttttcttttcttttctttttttttttttcttgagacagagtctcgctctgctgctctgtcacccaggctggagtgcagtggcgcgatcttggctcaagcaacttctgcctctcgggttcaagcaattctcctgcctcagcctcccaagtagctgggattcaggcgcccaccaccacacctggctaattttttttatttttcatagagatggggtttcgccatgttggcctgcctggtctcaaatttctgaccccaggtgatctgcccgcctcagcctcccaaagtgctggggttacaggcatgagctaccgtgcccagcaatctgttcctttttattgctagtttttaattttatagatatatcaccttgtttaatcttttcaccgcttgatgacatttgggttgtttccacttttttggctattattaatactgctgctgtgaacatttgtgtacatacacctactatgtacccacaaaactggaatttgaaatttcaacaaagaaggtgtgaggttattgatagacaagaggggccattttataagtgatcgaggcacaattcattatatacatgttgagccactgagagctcctctaacacaccatgttttggtacatagctagtaagtgaaaaattaggtagcccctgagtacttatttaaattatctgcctcttttggataaatgcatggaaaaattctaacagttacagtttgttaaaacctgtaaacaaatacccaattagcagcaatctcattgagactatcagaagctgaaagaaaccacactcaacttcataactcaagtagaattccccttgcgaaaaaaaaaaaaaatccatggtagtactggactcaatacacaattttgctaccaggtaaccaacaacaaaaaaaacagtttgcataaggtcaactatctctaaacacaaattcacagttttggcaaatattctccaaggtttaattggtttatatcaaacaactccaaacagcatgtcagtcatttttattagtaaggggcacatttcacaagtaattttctctagagggttcactgagaagctttcaaactcagacatttctcagatggatttctgagatttttctcggggtaattctgctttgaaaatcttccaggctaaaattgccaaagccacggtctacagtgtagacctttggaactttgttgattgatctgcccctatcctggagcagacccagaattgtattctgagaaaaatctattaactgtctatagtgctcctaggccttctccatgcagaggtaggccaatgtctattcaagacaaagtctagcttaggcaccttaattttcataaggggacattaacctttttctctttgctcaattgatctctaaaatacatactttttgaagtatattagctttataatacatgtgcttcaatcataacaccaaataattgctctaaggcatttttcagataataaaatacctgacagtcactacccagcttttatcaaaagacgtaagaaataatattcatagagaatccataattaattcataattcaaggagataaagtctacccagcccaacaaatagtttagatttttatccctggatcaatccaggcatgcgatgtggctgaagtataagttacgggaagggagaggctggagaaggttgtaaagagacagccaggcttgggattatatttcaaaggccttatagcccatttattcagtcaccatgaaatgctgtgtcatcaaaggatttcagataggtaggacgctgttacataagaccaggtaaaaggtgattagtatcttagcagaaacagttataatttgaatttaaattcaataggactgaaaattggttgaatgtaggagacaaaggaaaacagtcaagatgactcccgtagcatgggccctgaatggagaatacagaagaaacaggttggggcaagaagttaataagctcagtgttaaaaatgctgagtttgataccccatagagtatccccagaaatgacttactgagttattcatgaatctgaagcttggaggatatgggctggtgatacaggtttgagaatcatcagcaaataaaagacaattaaaactataacagctacctacctgctatgtctcctaggccaagtcacctctctatgcctccattttctgatttgtaaagtgaagattatcatacctaattgagggttacttaagaaaattactatacttttgcttagtatgctcttgatatatgtcagttgtttaaaaaactaaattaattgccaagattgccttgcaagaccacatagaacaatggttattacacttttggagagaaattaatgcttttgagaatagctgtaaactatggactttcttattagaaaattacacataatcaaagacccaaatttttgcacagaatttcaggaggcctgtggatcactaaagaacctgggtttaaaattttttgatgtacaaggggaagagggaaaatctgagaatcaaacaggaaaaaaaaaattatgaaatgagcagattaggagaagaccaagaagagattatcagaaagcggcaaacatcaaacagtttcaagaagaggctgtgaccaattttcccaaatttggcaagtagggccaataagatgagttaaaatgatcattggcaacattcacgaattgtattagtctagtgatgggagagaaaattagagatcagtcagttaaggagtgaaaagggagtggaaaagcagtggcaactcatggacaaaaaggaagaaaaaagatggaatgaaagacaaaagagaatttgtggtcaagaaagggctgactttctgtttgctgtgtttgttttgttttgtggtcatgagaatttattttttgttgttttggggtatttcgtttgttcattttttaaggatgagaaagatttggggtgtatggactcaggattggagccaacagaagggctaaggtggaagataagaacagagtgggaatgactgatgaagcaacattccaggaatggagatggggaggaaagaaatggaatcaagggctccaggagagggcttggctttgtgctagaaggacacatcatcctccaaatatgtggaaaggagttaagaaagtgtctatatattagtaagtgctgggcagggtggacaattgatggatgactgtaactttctcaagtaagaaacaaggtggtttttgggagcctgaggcaggagaatcgcttgaacccggaaggcggaggttgcagttagccaagatcgcgtcactgcactgcagcctggcgacacagcgagactccatctcaaaaaaaaaaaaaaaaaagaaaaaaaagcagattaacaaggtggtttactgagaacattggcagttaaatgttgaggaaatgatgaagatttggaatagaagccaaagaggatgataaagaaagctaagcaaaacaagtaaacttgtattactctggattaagctcttggaactcatttctcataagtttttaaaatcttgataaccactgatgagagaatacaccaaataagtattttggcaattagtcttcctatttcactagcaattgtgtttagataaaaatcattataattacatcttaagcttcttgtaatacattagacttacaaaactgcaaacactatactagatattatgtatgtatatattatattatattatatagatcatatacattatgtgatactaaatgccaaaattttacttgatgttttgaagtgcttagtgttgttcaatgcttactttagccagctgttatgttttcagacagtgatttgctttagtcttctcttccttgcagaatcataaggaaccttagcttatgagagcagtttcttcaagaatctgcttattagagtaaatagaatgaatttcatttcgtacagttactactacaacatttgatgataccaaaagcaaagtgaaacctgaagcatgctcacataataaattacaaaattttccatatgaagcattctttattttctgaacccaaagctctgtgtccctttgtaatgaatcagcatctcaggcaaatgttcttgtgaggaggcaaatttttcccactggatttagcacttaaaacagaagttgtccccaccaccaccacactttctaaatacaaagagccctgttataagatagtctcatctgagttgtttttcttttttcttttagattatgtgggaaatgtgttgcatatttgcatttagtatttgtgcaaatgttttaaacctttttctccgtgttgaagctggtttcggttatagttatccgaataagggggggaaagaggtgaaaggacaatatagtttaaagtatttaaagccctaaaacttcacaaaccaggaattaaatataaaggtattcgagttttttctgacttatgaaaatttaaagagcagtaccggccgggcgcggtggctcactcctgtaatcccaacgctttgggaggccgaggcgggcggatcacgaggtcaggagatggagaccatcctggctaacacggtgaaaccccgtctctactaaaactacaaaaaaattagccgggcgtggtagcgggcgcctgtagtcctagctactccggacgctgagggaggctgaggcgggagaatggcgtgaacccgggaggcggagcttgcagtgagctgagatcgcgccactgcactccagcctgggcgagagagattccgcctcaaaaaaaaaaaaaaaaaaaaaaaagagcagtaccaaaaatatgtaaggttttcttagaaaatataaagtgctaacctaaaaaggaaaataatgtatttgccacatttaacaaacacttatggaccaagataaaacagatagcccataaatttggcgttgtccctttaatgtacatgtctatagtgccaccatgtggtactaccggtgttgtaaatatttctaaatacagtaattcagatattctgaaagttagacactagatggcagtatatttccctttaaaattgtttattcatgttcaaaggcagtatctattttttatggtataactttgttgaaaagtaaaaaaaattactacagtttttaaaataatatgctttgtaacatagactgattgcattaaaaagtatgcttttaatcatcatttatttctcaaatagaagcaaaatattaaaataactacttgcttcctttattagcatgcccaacctaggcaaaagaatctcaccaattttttcttcttctactaaagtcctgtgattagcacagtaggatccaactgtattgattctatataattactaattaacaaaattttactaagtaaagacttagaggcagaaaaaacaatgagaaatttaggcaacgagtcagcttaggttcatttatgtactgtcttcaatggctaaagaagaaatattggcaggggagggctatgactttcattctatctcccttttatcctgcttctgaggctaagggctcttcctaatttatcctggcaatcagaaagaaatactctatgccatcctgaaatacaaatccaagatgcattgttcaggaggttttcctagttggaaacagcaagtgctacatgatatatcagcatccaacagagccatggctttttgtatagaaatttgtcttttccttaatataaacaaaatccagatcttccaaaactgtcaaaggatcaccaggcacacaaaaaacgttagcaggagcatgaagccccaactctagttaatgtattaatttctcctttgggctcttgcttctgacatctgcctctactaggtaggtttgagacaagaagtaaaggaatgctcatttacctttaatatcctagcccatttttggacagagaccctgcctttaacaccaataagcaaaactacaacagagctagcatatttaaatgagacttaactaaataaaaaggaataactatagattgcttgatagaaacagaattacattagttccatcagaactagtttcctgatagtttttataattaatatgtaaaaatatttaactatccccttgatttttgagtactcactgggagaaaattaaaccatgtcctttccctggaatgattctaattcctcacaagaaaaaacttgagcttggaaaccttgagtcttgatagaatttgattacctttgagatagcattgggggtggaaggtggcaaggaaatagcctttttgtgctttggaactaaaaatatgtagaagtgatcttcaccaataaccctctcctcacacatatgcagaaaatcaggactttgggaaggtacatgaggcaagtgggctaaattgtttgaaaaggggcctgtcataatgggtggaggggtaaatggctgagctcaagtactcgagtcctccaagaagaagagggaggaccaggctgcatgttcccacccactcccatacagatggtgaccaaaacttcacccccaaattgaacaacactcctgaacaaccaaagggtcaaagaagaaattttaaaaaataacttgagacaaacaaaaatggcaacacaacataccaaaacttatcagatgcagcaaaagcagttctaagagagaagtttatagtgacaaatgccaacattaagaaaaaggaaagttctcagataaacagtcgaactttatacctcaaggtatagaaaagaataccttgaggaactagaaaaaaaaagaataaaccaaacccaaaggtagtagaagaaaggaaataataaagattagagcagaaataaatgaaatagagactagaataacaatagaaaagatcaacaaactaaatgttttttgaaaagttaaacaaatttgacaaacctttagccagactaaccaagagaaaaagagaatactcaaataaaattacaagtgaaaaaggaggcattacaattaataccacagaaaggcgaaaggtgatgaggccactatgaaaaattatacaccgaattggataacctagaagaaatggataaattctttttaatataaaacttaccaagacagaattaggaagaaatagaaactctgaacagaccaataccaagtaagaaaattgaattactgataaaaaaaaaaaaatgtcccaccaaagaaaagcccagtacctgatggcttcactggtaaaatctgccaaacatttaaagaataattaatgccaattcttctcaaactcttttaaaaatttaagagaaggaaacacttccaaaattattttatgagaccaacattaccctgtactgaagccagacaaagaaattattttaaaaaattacaggccaatatccctgattaatatagatgcaaaaatcctcaacacaaataatactagcaaactgaattcaacaggacattaaaatgatcacataccacaatcaagtgggatttatccctggcatgcaaagatggttcaacatatgtaaatcaatcagtgtaatacaccacattaacagaatgaaggataaaaatcatataatcatataatcatctcaataaatgcagaaaaagtatttcacaaaacacgacatcatttcatcataaaagctatcaacaaattaggcagagaaagaaagtacctcaacacaatgaagaccataaatgtcaaacctgcaaataatacactcaatgatgaaagctgaaagcttttccgcaaagattaagaacagagtaagggtgcccactatcactacttatatttaacatagtactggaaatcagacctagcgcaatgggtcaaaaaaaaataaacaaaaagcatccaaattacaaacatagatgtaaaattatgtggttgcaaatgatatgatcttatatggaaaaagccctaaaactccaccaaaaaagtattaaactaataaacaaatgcagtaaagtttcagaatacaaagtcaatatacaaaagtcagttgcatttttataccctaacaatgaactatcaaaaaagaagttaaaaaaatcccatttacaaaatcaacaagaagaataaaaatacttgggaagaaatgtatccaaagaggtgaaagatctgcacactgaaaattataaatcactgatgaaagaaattcaagaagaaacaaaaaaaagaaagatatcccatgttaatatcaatattgttaaaatgtccacactaccaaaagcaatatacagattcaatgcaatccctatcaaaatgccaatggcatttttacatgaatagaaaaatcaattctaaaattcatctgaaatcacaaaaaaaccctgaatagccacacaatcttgaggaagaacaaagctggaggcatcatatttcctgatttcaaaatatattgtaaagcttcagtaatcaaaacagtatggtactagcataaaagcagacatataaaccaatggaacaaaataaagagtacggaaataaatccatgcatttatggtcaactgcaaaggtgccaaacacacctttgtgaaagaatagtctctttaataaatgatgtcaggaaaactggatatctacatgcagaaaaataaaattgtacccttatctcacactatatacaaaaatcaactcaaaatggattaaagatttgaagctataaaactgctagaagaaaacaggggaaagcttcttgacattgctctggacaatgattttgtttttactatacgacctcaaaagcatggtcaacaaaggccgggcatggtggctcatgcctgtaatcccagcactttgggaggcccaggtgggtggatcacctgaggtcaggagtttgagaccagcctggccaacatggtgaaaccccatctctactaaaaatataaagattagccaggtgtggtggcgggtgtctgtaatcccagctactcaggaggctgaggcaggagaattgcttgaacccaagaggcagaggttgcagtgagccaagaccatgccattgcactccagcctgggcaacaaggagcaaaaactccttcaaaaaaaaaagcatgggcaacaaaagcataaatagacaagtggggttggattaaattaaaaagctctgcacagcaaaagaaacaacagagtgaagagataatgtatggaatgggagaaaataaatgaaaatcatacatctgataagggcttaatatccaaaatatgtaagaaactcaaacaactcaacagtaaaaacaaaaaaccccaatatgaaaatgggcaaaggacttgaataaacagttctcaaagaagtataaatggccaacaggtatatgaaaaaaatgctcagcattactaatcatcaaaggaatataaaccaaatgcataatgagataacacctcacaactgctaaaatggccattataggccgggcgcagtggctcacacctgtaataccagcacttgggaggccgaggcaggtggatcacaagttcaggagatcaagaccatcctggccaacatggtgaaaccccatctctactaaaaatacaaaaattagctgggcatggtggtgggtgcctgtaatcccagctactcgggaggctgaggcaggagaattgcttgaacctgggaggcagaggttgcagtgagccaagatcacgccattgcactccagcctgggtgacagagcgagactctgtctcaaacaaaaacaaaacaaaaaaaaacaaagaaaaaaaaacaaaaaaaaggctattattgaaaagtctaaagataaattttggtggatttagaaaaaatggaacttttgcacaccattgataggaatgtaaaatggtacagctattacaaaaaacagtatggagtttcctcaaaaaactaaaaataggactaccatatgatccagtaatcccacttctgggtatatatccactggaaatgaaatcagtatctcaaggagacatctgcacacatatgatattgcaacattattcacaatagctaagatatagaatcaacctaagtgcccataaatggataaagaaaatgtggtattatacacaatggaatactattcagccattaaaaatgagggaaattctgccttttgcaacaacgaggatgaacctggcaaacattatgctaagtgaaatatgccagacacataaagacaaatgctacatgatcatactcatatgtggaatataaacaagttgatttcatggaagtagagaatagagaggtggttgccggggactgggggatgggcgaaaggggaagatgttggccaaagggtacaaggtttcagatatgtaggatgaataaattctgaaaatctaatgtacagcatggtgactatacttaatgtactgtatacttgaaatttgccaaaagaggagatcttaagtgttctcaccacacacacgcacacgcacacaaacacaaaatggtcactatgtgaggtgatgaatatgctaattatcttgattgtggttaaccatttcacaatatataagtgtattaaaacatcatattgtataccctaagtctatgtgatttttatttgtcaattataactcaacaaagctggaaagaaaagacccaaatataggcccctagatatggcagaacatcatatatagaatgcatcatgggagctttggccctggtagtgggcctgggagcctcagcagaaatctctgtgcctggctttaccacaagagaggaagtcacagacaatacctcctctctttgcctggactgcaggactatcctgggcaataaaaactgatagcaacaatacagactgcgtgggagcttccccccatttttctgggtgagtgaggcctaggtttctcatgcaatccaaagggaagagggtgtcccctgacaacttattatattaatattgaatttctgctgggggcggtagctcacgcctgtaatcccagccctctgggaggctgaggcatgtggattgcttgagctcaagagtttgagaccagcctgggaaacatggtgaaacctcgtctctacaagaaatacaagaaaattagccaggagcggtgacacacaactgtggtcccagctactcaggaaactgaggtgggaggatcgcttgagtccaggaggtcgaggctgcaatgagcagtgattgtgccactgcattccagcctgggtgacagatcaagaccgtgtcttttaaacatatatatgttgaacttcttgtccgtgctaaggaatggagggatgaaccagacaaatagtagggaaatgtgacatttaaaaatactgagtgtaaactgagcaatgtcattctttacatagataatatagctcacacattatgatgtgcacggcttgaagcctggctgaatcaaggctctaggatccaagtaagtgacaggcactatcgtagaactcaccagatatgatttggatatttgtcctccccaaatctcatgttgaaatgtaatcaccaaggttggaggtggggccggctgggaggtgctcaggtcatgggggcagatccatcatgtcttggtgtcgactttgtgataatgagtaagttcttacgagatctggttatttaaaattgtagggcacctccccgcaccttgctcccactctcgccatgtgatgtgcttgcaaagctccctgaggcccctgagaagcccagccaagatgctggtgccatgcttgtacagcctgcagaaccaagagccaattaaacctcttttctttataaatgacccagtctcgggtatttatagcaacacaaaaatggcctaacacaccacctctcctaagtacaaacacagtatctctgaattttttagactaagagattaagacccagaagaacaggaaaatttctttttcccacccatgttagtcgagttcgaagaggggaatttcttcttccaaccattgttagtccagttcccagctaagaatctcctcttctccgagtggctgacctcagggattagcactcccttgaccagagatgatgtctacccacaggggtgtggcctcccagtctctacaaagtctcacaataaaactgactaaccacctttactcacacagaagacagacaaaaacagtatacaaatgtgtattttgttatatccccaaatcccattgttacagtgtgacacagcataataattattaaatattttccttttcagaggaacacttcttattctaatctttagttcaccctgcagtaatgttggggaacagctgtggaaagaggaaataatccttctgttccccaccccaccacctctatcactattaaacacatttttgttttcagattcacgaatttctgaacatgtattctccatacagttttacaaagtgactctttttttcagctcttgaaattaatacctcttgaatttagtatgcaaacatatgcaagtattctggaaatgcaacagaccccagatgactagctaaagcttagagactgtatgacaaagcactttgagctccccagacacatcagggccttcccagagagtggtcttcccatgcttgtagagttgggttaacatttcctttgggtaatttgaatacttcaacttcctcaggctgcaggtcctaaagccttttgtatacaggaagaatggtttactacttctttgagttctggcttattaattatagcaattattttgttcacctatacagcatgtcaaactgttatttatctgcttaatcagcacatcaggaaataaaaagccattgcctgtgtaagaaatactgacctgatgaaatatcttggaggcattcctcagtaccaattaaaataatagacattgtcacatggtgcaattattttccagaaaacagctgacgtgtacacactaagcttggcaaaattcctggctaatttcgcaagaatgtttattccaaactgagatcatctttttaaaaaaagaaaaaagacacagacaaagagggtaaggagggagggggagatgaaagtggagaggcagaaaaggaagggtaggagacagaaaggaaggaagggtcgaagggagggaggaagaaaacaaataaggaagggttcttcataaatcaagagaagatgttagattttaaagtcgtcttttctctatctgaccagatatctacctaatcctgcaacgaaattttattaattacagaagaggtcaaatatttcatctttaccagagattcattaatttaaaatgttctaacctcaaattcacattacaaaatcatagcattaggtctttttcagattttaataatttccctaattaacacaaatgattttaaaggaaattaatcaagaaaaactttatttcagagaggttcatggaagaggaaaatatagagtgaacatttacaaataaaaacaaacattatagaaatgcagagtcatgactgatgcattccaaccttgtgcatgtctggaatacatctgcaaatcatctgctcagccttcagaatagtctgtacacacacacagatacagccacacatacacccagagaaacccaggcattgtcaagcctggaggaagccaatgttgacatgtcagtcctttatctggtaagaaagaagcatgaactgctctatcacacttagtttgtttctgatttctggatcctactaaaaagcaaggaggatgaaattttttttcttttctattgattcagaatctggaattttgactacaaaaaaatttttttggaaatcttgccattagtctaaggcagggggttacttaggggttgaaatctattagctgctaatgtttttggcttagtgagaataacaggatttggggttctgaagggaaatagagtttgtagcttgcttaaaacttactgtagacccccaaatattaagattttaacatttgtattattaatgataatattattctttttaaatctgcgtactgtttttctaaatgttgggttctagagaaatatatttgaatagcacttgcaacttccatgagtttcttaccaatagtaaagttatatggtaggaatcccagataatggcttcacaactcaatttggaagattatgtatagtttaaagatgttatgctaagtttgctttaagtgctccattcagcaaactatgtgcaaaaaatgcagatagaatgatggatagttagattaaattatcgactttctgaactttccagttcttactctgaaaggatttcaattaaggggaagaagtagtgtagtcttaatataaaagtatgaagtaggttataaataagcttttattttgtgagtttctaatcaataagctcataattcatggtaactcttttaggctaaataagattatcaacatcatgacattttctccttgctagatcttcattttatatagagattcttcccttaggaataaaaaaaatcagagaaaaaatttcattatatattaggtacagtaaatgagtgaattataactatacctttattaacattttagttgtattacagtcaacaaggaaaaaatggtctaaggagatacattatgtttgcaatgttaactctttcacataaccagtctcttttttttcccctgagtaaatgcattttatcacattttcttgcaaatttgtatcttcttttcttccctgcacaagaaaagtttaacccacttacattctttaagaaagcattgatgagactagaaatgatcagtattacagatgtcaaattaatgtaacatattccttcaatccaacatgcattgagcatctactacatgccaggtgctctgttagatgctggggatacaagttaaataagatgcataggcccttaactcaaggaggtggcaatctattggagaagatactgacaaacagaataaaatgtgagctttttattgtggaagtatagcagttggaactctttggttgcaaatgacagaaaacatgattcaaactggcttaaacaacaaagaaatgaactggttcacatgacaaaattggagaagggggaatggtacatacagcgtatctcaatccagagattcaagtgacgtcaccgggattggtttgtgcacctatcttaggtctaccttcatctgcattggatttgttctcaagctccagtgaagactggcaactcccagctcatttcttactatgtattatttgaggagattactcttttagtaactcacattgacagaagggtcagatttgtagaagttaataatgcatctttattttgtctttcctttcctcttggttctgcacttctgctttccagaatcatatttctaagtaaacttccggtacataagtctttgtctcaggctctgctttggagagacccaacctatgactgggatgttattccagcacacattaacccctaaatttgccccgatctattattgcagactcccaacaaccatgcgtctacaatgtagtcatggtcccctggtcatacctgataaaactagggaaagaagcctaacagacaaggtgggcaactcagaaatttccccaggggttgatgggaaatggactgaggaaaagttgttctcactgtggtggacgaagcttaatgactcgctttgcaactttactggagcacattcagtgagctgatggtcagaactgaggaacttcatccataagcagttgtcaaaccattgggagttggaaatagaccacggtgaaagtacctacattagaaaaatcagcaactgttacaaatccagtctttttccacccagacagccaatttgctagcacaccactgccttcttccctttgtagtattctaacacctgagaaaggatgagtgcctttgttctgtttacagagcaaagtacagatgaagcaatacgggtcaggcaaaatcaaataatctccaaactaagagctttgttaactcctgttggggcacacaactttgggctgaggtctctcctgaaatgaagacctcgcctgaaacgaattcttcttatgaaataattttctctgggcccacagggcaggttccaattgatctagtaacctattattgggcttagaaactaaactgagcttgccagagaccatctttggtctggtctagttagtaccaggagacaaaggacaagtgacaacacaggtccacgaattaacaaaagacaggagagacatgggactgtgccacccacaatctgaagccatgacctcaccactgcttagcaaacctcagtgtattgcttgatgtcactagtaacacaaaccagtcctcctcctatgaggaggaacatgccacaggaataggaagaaggatggaattgcttcctctgttggggttcagaaaccaaaacatggcacttcgatatgctgaactgaagaagcagccttaaggtttatttgaccttccccctacctcctttcgctcaatcctgtctctctcaaagcacaaggtgaagttgttctctgaagatcccttgtctgcctgaagtctagacctggcaataaaggaaacaatgaccactgttttcttctttgaatttttattaaccgaactaatacacaggaagaaaagctgaagtctgtcaacaaacctggacagaattttgtcacaaaccatcgtaggctcttcaggcccaatagattttgtcccaggccattatatgttctctaagcccattgaattcccctgaaaatcagttactaccctccaaaaatcatccacacttttccatttcccttccccagttacccattgggatactgggtaatcactctgtggtttttctcctgtgcacactaataaatttggatgccatttctcctattaatctgcctttcgtcagtcgattgttcagcaaaccttcagagggcaaaggaagagttttaccttggctcttacaccttcaatactgcttccttctggagagaaaaggagaagagtctactcctcaataaaaatttgcagctgccatgttatctgccatgagatctgaggagcagaggaagccactgctgaagggaagaatgaagcacaacatgagatggagagcactgctgctttaggttcctggtagctttcagttccttcggaggcccagcacgtaaagcacttagtacagtatggagaatggcattctatgaaagttgatgactattaatgccagcatactattgtcgatgactattaatgccagcatactatttcagagattgtaatttttaattcatttagtcaatctcctcctactaaatatttagactgcacttttagttctctctccaatatatgtatatatatcagagaaagagaattatataatcgtgtgtttgtgtgtgtgtgtaattattctggcactcattaagccagtaaggaagactttattcaagactatttatagccaaggaacagagtgaggggatcagtggatggaaaattactaagaggagacatcaaggtaggaggattcttactaaactgacctaacaggattcttgctaaaggtgggccaaggacttataaatcaaaggtaggggatgaacttggtcacatatcaagggtgacccaatatgagtgggacagggggagggcacagatttttactgaactgggctatgcaagaacaggacacgcatacaggaagccaaggtcagagctagttgagaagaggactcaaaagcataactaaaatttggtcaaggagggagtcttcgttgagagagaaaaaaatttttttgattaaaacaaatgtctagtaatacaattcagtgaacatgtatgaagcattttcataatttttgttacacagtatcaatggatttttgaaagaattgagcctatttgcagtacaaatacgtgacagtatgagtttgtccaatttttcacagccttttttgatcaattcataatatatgtaagtatacagaattcttcagccattcagaaaagaaaaggtgtaagcacaatcatccaatttttttgttttatgaacaaaattggatgttttcctcattaaacttacagtgcttttgaagttattttggagttgcagcttctgtaacagaggtcaggcattcttgttctctttgttgtctgaagtacactctggagtttatcttatatgaaatggtttccactttctaaccatttgttccagtaaaatctagaccactgctacatgcaagagaatcaatttcctgatattaatagtctgcatgtttgtttttttctaactgacccaatcaggagcaaggtaactcctcagtcacagtttatttttctgcccagcctttgaaccatttactaggtatttatctagtcattttcttcattcagcttccttcccatgtgccttatatataatcacttgaagcagcacagcagacgcaggtttaataagatagctctcactatctttgccagatgcaacgttttccagttttctcttagaaaatgcaaacaattggaaacagttataacaacgcagtttaccccacacagataactcgaacactatcactagaggattccacagtgaagtgcccatggtatggagaacaatatttccctgttctttcactgaaatacctctgcattattttcctaaaacagagaactactaacttggacaaagggcaggcagttcatgccatccatcctgtgcagtcacaatagctaattataacagccaacctttattgagccctggcaatatgctggtctctgttttaagcattttcatgtgcttaaaatgtaattaaatttcatttaaaattaactcaattaattctctctaaacctacgaagtgagcatcatcagtatcccattgtacagatgaagaaactgaggaaccaagaagttaaaaactttgctcaaggtcacataacaagtaaggggcagagctaagtttcaaactcagaccctttgattccagacaccaagttcttagatgtctatctcaaggacaagaaagaaacaataggccgggcatagtggctcaggcttgtaattccagctcttcaggaggccaaggtgggaggatcccttgagctcagaagttcaagaccagcctgggcaatatagtgagacccccatctctataaaaaacataataatttttgtaaaaaaattaagaaacaaacaataaagccaaattttccgcaatgacacattagtgatgtttccatttacttatctaaaaccttaaaaacacattcataaattcattccaactgctctaggaacttccattagctcacaatccaacctctaaaactttgtatttatcccaaactctaaaaacttaaatattttacgcttcattggttctttggggttactttaaaagccagtaatatactttgtcattcttagatgtcaggcaagttcaaatttattgtcagtccttgtcttcctaagttgaagctcactcatttgctaatatgcccttacacagcagctctgctgtcctttttccatgtaattgttagactttccctaacatctttacacattttttttaagatgtgttgaccggaactacaaagaatattactggcttatatgtaaaaggtccttgctgaagtatagggaaattttattttgtttttactatacctctcatgatgagtgttcttgacctttttggcaatggagacacacattgtctctccttggaaatctatgtctccaggatcataatgaaatgtctagaactgtgatatcatggaaagaactctagcctgtacatgggtatcccaggcccagttccctgctttgccaactttcaaaagtgtgattatggagaattatttaaaccttgacttccttacccacaaaagggaacactgatgaaccactctatatgggtggttaaggacatagatattgaagccaaaccacctggttcaaaatctagcttacttgtctatgggtgttaacttgggcaacttacttcacctttttgttcctcagtttcctcatcagcaaatgaaaattataacactaatacctactttcaagcatcaaatggttgttaaaaccatcagatgagttaataaatgtaaagcactgagaatctagaacattgtctgtaacagtaagtgttaattattgttacattacaaggataccatgagaatgaattaacatgtagtgcctgaactattagtacacacctaaacaccagttcatttatgcagtcatctacagtgaccacttagtacatgcaaggcagtatgctagacacaggcatataaaccaaaaagtcacttgtcctcactagttatattttcataagaaaagaaaataataaaccagtaaataaatataccacaaaataataaccacaagataataaatataccaaggctcaaaactcttactactaaaaaaaaaaaaaaaaaaaaaaaaaaaagaatggcgttctgagagtactcatgatgtcacagaacctgaatctgtctgagtccaaactcccaggctttttccgtgactttttacaaccttctagcaaacaatttctacaaagagtgaaaagtatcaagatggaggcttgcacctgtggtggcagtttattttttccaaatgcattttctttctcttgccattagcctcaaggcctatatatggacctctcctcaggcaaagaatcatctgatcccaggcatacctgcagttcccccgcagctggtacacacgctgcacaagcccagtgctttggatgcgagagttgactttgaagatacctactttaggtaagcatctcattacgatgagtagaataattaacaaccacagtaagtgcttttctgtactaaaaatcttaataactttcggcacgttaaaaatagccaaaatgttctaataaaaaatatgctgttgagttaacaacaattaagtgaaaagcagataaaaataaaattaacaagtgatccaaccccttcataaatttacacatgggtgatctcagtaaaacgtttgtttttgttttgttttaagacctaactgaactgtgataattgctttctctttcaggagcagttacaaatattttgtggcaggaagtcttcccttaagtgctgagtctgcaccgcgacaaacacacttttaaagaagaaaactgtataagcagcaatgtcttcatagccaaccactggttcaatcatttaaaaagtttttaatcaaggacccctagaagggagtttcctttataaaaagccctctgattacaggcgtgagccaccatgccatttgtgaggccgaagcgggtggatcacctgaggtcaggagttcaagtccagcctggccaacatgatgaaaccccatctctactaaaaacacaaaaaattagccaggtgtggtggcaggcgcctgtaatcccagctactcaggaggctgagacaggagagttgtttgaacccaggaggcggaggttgcagtgagctgagaccacaccattgcactccaccctgtgcaacaagagcaaaaactccgtctccaaaaaaaaaaaagccccctgattcacagctcaggagtaggaattcacacagtttctaagcctgagcaaccttagaaaagaaagaaggaaacaaagatgtgaaaaatttattttgcatagactcagtcagaaagtagtgagaagtctggtcacagaataattttatttaggaaaacagaaatctatgggacaataaattctatagctacatggaaaatggaaataacaatggcagcttatgtcctttaaagccatgcttccgagactctaacgtgcatatgaatcacctggggatcttattaaaatgcagattctgattcagtacttctggggtagagcctgagattcagtaaatctcacaagctccttggtgatgccaatgctgctgacccctgaaccacactttgaccagcaaaaacacatttgcttattgtaaaggttatatccactgttaagtttaaacaccatttcataaattaatgtgaagaagagttaggaattaattgttcattcaatcaacatcattgagcttactatatgctaggccttatggcgggtactaaacattcaacagtaactaaagcaaaaagtacacttgggaggctgaggtaagcagatcgcttgagctaaggagttcgagtccagcctggacaacatggtaaaaccccatatctacaaaaaaatacaaaaattagccaggcatggtgccatgctcccgtggtcccagctactcaagaggctgaggtgggaggatcactggagcccagaaggtggaggttgcagtgagctgagattgcgccactgcactccagcctggatgacagagtgagaccctgtcttaaaaaaaaaaaaaaaaaaaaaaaaaaaaaaaactacccttgatcaatctactttcgactgttctttcaagcaagtaataagcacagggcttacaagaacttttgtcattcacaattcaaaatgtatcaatcatgcttctcgtgttaagtttttcttgatgtaacatttttaagaatgcctcaattcagattgtttacacttttttttttttagatgaaatctcactctactgcccaggctggagtgtagtggtgtaatctcggctcactgcaacctccaccgcccaggttcaagtaattctcctgcttcagcctcccaagtagctgggattacaggcacctgccaccgcgcccggctaatttttgtatttttagtagagacagggtttcgccatcttggccaggctggtcttgaactcctgacctcgtgatccacctgccttggcctcccaaagtgctgggattacaggcgtgagccaccgcgcctggcctgtttacactttaaaaataattggcaatttaatccagtgaattagcattgctctattttatatgaactagtaataaaattttaaaggttttcatatgcatggcatagtttaccagcagctagctaccttattgcaaatgttactgggtcatttcaattaaaattaaagcaaataggaaagtggcaagaaatgtttcatttaattttggcttagtgtggccaagttctccaggtgaatgtcatggcttctgcctcaaatttgtatgtatagtacagatagtagaaaaacttatactcatcaaagagttcatctttttttttcctcatgagcatgaactaccgccctgctgcatattaaatggcaaaacagaatcaccagaaagtttcaaaatcctaacaggttagacatactaagagaacagatgacctactcaagattattttgcttccccaaaaatggataactctcagcaagaagggagaataagtacatgaagggccatgtatattcacaaagagcatctgaaccaagtctttgcttaccagattttacctttttaaaagatgccaggaggtggcagcatttgttgcagctgtgtgagtttactcattaaagcacaggttctcagaaagtctggtgtatcagatttggaggagaagggttggtgacaagcataaggtggcaggagtctgttcggattaaaaaggcattgggacaatattataacacaatattatacttgaaagcaaaataaatctggtgtcattggtgttctattaaatcttaaaatcttgggtagccatatacaaaaattaactcaaggtggatttaaagacttaaaaaacctaaaactacaaaaaccctggaagataacctaggaaatactattccggatataggatccggcaaagatttcatgatgaagacgccaaagcaattgcaacaaaaacaaaaattgacaaatgggacctaattaaaataaagtgcttctgaacagcaaaagaaactatcaacagaataaacagacaacctacggaatgggataaaatatttgcaaactatgcatctgaaaaaggtctaatatccagaatctataaggaatttaagcaaaaaaaccaaacaactccattttaaaacgtgggtaaaggacatgaacagacacttcgaaagacatacttgtgatcaacaaggatatgaaaaaatgctcaacatcacttatcattacagaaatgcaaatcaaaaccacaatgagataccatcacacaccagtcagaatggctattgataaaaagtcaaaaaataacagatgctagtgaggttgcagggaaaagggaatgtttatacactcttggtgggaatgtaaattagtttggacattgtggaaagcagtttgacgatttctcaaataacttaaaacagaattgccattcgacccagcaatcccattattgagtatatacccaaaggaatatgttaaataaattgttctaccatgaagacacatgcacgcatatgttcttcatagcactattcacaagggcaaaaacatggaatcaacctaagtgcccatcaacggtggattgcataaagaaaatgtactacatatacactatggagtactatagagccataaaaaagaacgtgaccatgtcctttgcagcaacttagatggagctggaagccagtatcctaagcaaactaacacaggaacagaaaaccaaataccacatgttctcacttataagtgggaattaagtgttgattaaatatagacacaaagaaaggaacaatagacactggggcctacttgagggtggaggatgggaggagggtaaggatcaggtactatgtttattacctgggtgatgaaataatctgtacaccaaactcctgtgacacataatttatctataaaagaaacttgcacatgtacccctgaacctaaaataaaagtttttaaaaaaaatcttcagtagtgggaatatacagaacttatctgcatcttcaaagaacagagtgagaaagacaaaggagagcctggattttaactgagaggcatatgactaaagtgtagttccagaactgtctctataaacaatttccttcacacatcattatatttgctaagggtttggtatggtgccaactacagagtatgaaaactcagtaaatatttctttctttctttttttttttttttttctgagacagagtctcgctctgtcacccaggctggagtgcagccgcacaatctctgctcactgcaggctccgcctcccgggttcacgccattctcctgcctcagcctcccgagtagctgggactacaggcgcccaccactacgcccggctaattttttgtatttttaatagagacggggtttcaccgttttagccgggatggtcttgatctcctgacctcgtgatccgcccacctcggcctcccaaagtgctgggattacaggcgtgagccaccacgcccgtcctatttccattttttaacccattcccactgctgagaaagatttgctcaggggcagctgttatttcactaaccaatagcagtgcaatttttgcttctcatacttttgtcataggaaaatcattacaaatataacagccataaatgtctcggaaatcatagcagatgaacctggcagccagataatcaggaatgaagtgccctttctaagagttcagtctaagaataagaatcacaatgaatgtgattattctagttgccacagccccgctcagtgttcagttttaaaggcttcccgccttatcatcaatcagtctctttacctatattcctacttagaaagatattcaacatatgcatcactatttttaaattatgaattaggacacattagataaaagaaactcttttttagttttttttaaaaagttgatctgcatttatcctgttgagatacacttttaagacttgagaatatatacattaaaagccctactatccttttctataaaattctacctcatgatcagtgtactattttcattattagaacagatatcaaaacttcagaaaccaaaatttattctgggataatgtattcatttttttaaaatcttgtgaattcttcatctacagtaaactaaaagatgaacaatgaatcatgtgtggcttggtatgattcaaaattctgaagaatagacttgttaattgtcacatattctttcctaggaaagaatatgtgtaatgttgtgacccaaaccgctttcaaaaaatccaccaaattctactaatactaaggtttcaaatgggaaatttagagctagaaaaggtacatagagataatataatccaacatttttatatgacagatgggaaaatttaaagaattcaatcaaaaacatttgtaattttaagaatgttatttgctacatccatatagatgattactatgtatactttacataagaatttttaaatatttgcttttgatgtcttccttctttttaggcaaaaaaagtctatattgctaaaaataagaataaactatgaattgcatatagccatatgtttcattgtttgatatgactgtttcatgagattctatctggctcaatatgatgcaggtttaactacagcgggcttaagaaaagataccaatatctatgaatctgtatagcttggaaaaaggagaaaatgcttagggtggcacaaatatttggaaaagcaagagaaaaaaatggaataatacaattttgtggcaacatgaagtgcaagcaaaacctgcttatgtcagttattagaaatcaaggggagaaaaatacatttggtaacaataggaaattaaagagagattttttttttagggactttttaggaagcaggttagatttgcctaagttgcttctctccaactttccattaaaatacctatgaatgtcattttttttaaactggcaatagttctgtaactcagaagactttatgccaaatttggggtggaattttcactaaagatggtgtcaagggagatggatagactatttagcaatttcttccacatcctgagccatacaggcagtcctgaagaagatggaaacatacttcaactcatcatctatttggtaaatcgattaatttcacttatcttcaaaatgtaggcactgaacacttacacattcctcaaacacataaaaataggtatctaataccctccaccacaattcagaccacaagtgagggagggagcccaaaagttggacataaaaatacatatacttgggaggaaatgtattcatagacttcaatatataatttatgtaagcaggcaattgcatttttaaattatcaatgtgttttcctcattcttttttgagacacatgactttcacttagtcttccctaagtaattacttgcctgggttacaaaataaatgcaaaaagaactggaaaggtcatggtggtgcatgcttgtaatcccatcgctttaggaggcctagctgggcagattgtttggccccaggaattcaagatcagcctggccaacatggcaaaaccctatctctaagacaaaacaaaaattagccaggcatggtgatgcatatgtctgtagtctaagctacttcaggaaggggagcagggaggggctgaggcaggaggatcacttgcccccaggaggttgaggctacagtgagccatgatggggccgctgcactacagcctgagcaacaaaccgagaccctgtctcaaaataaaaaagaagaagaagaaaaagaagaactggggtataaccaacagttgcatccaaatataagattttgtagcaagacaatgaacagtcatgtaagtcagtttagaccataaagttttacgtcagtaaaaggaaagttctcctaggccctgggaagaaaaggagctagaatagccagaagagcaagattatattgtaaatattataatacagttattaaactgaatgcaaaagccaaaaaaacttgatatgaaattgatatatttcttttaaaaataaatattataccagctccataagccctgttacatgacaaagactgaaatgctgggggtggggaattggagttaaagtaaagttctgctttcccaagctcctttgaccacatcccacaaatgttaataggaagtagagtgagtttaaattttagtcacaaactcgaatgcagcatatcttagtctcttttctgttgcttataatagaataactgaaacagagtaattttcaaagaaaaaatatatataaatatagaaaattatacattgaaaattaagtttccaacacatgaaatctggggaacattcaagccctagcattccaccccagccccccaaattcatttctttttcacatgcaaaatacacccactccatccttatagcccccaaatcctaacttggtgcagcaccaactcaaaagcccaaagcctacagtctacacaatggtagtataggattaaggcaaacattcccattccaaacgggagaaataggcaaaaagaaaagaataacaggccccaagcaaatccaaaacccagcaggacagacattgtatcttagagctggagaataatctcttttgagttcacacactgcctcctggacacgctggagcaggagttgggccctcaaggcctcaggaagctgcactcctatggctttgctgggtgcagccgctgctcctttggattggagtccagtgcctgaagctttcctaagtagatgttgcatactgctggtgacttcacagttctgaggtcatggtggcagtcttggtcccagagctccactaggctttatcctagtgaggactctctgcagtgaccatggctccactaggcattgccctggtggggactctctgcggtgcctcaaccccacatttcagctgcgcgttgcctactggggtctctctgtggtggttccagcccctgtaacaagtctctgcttaggtccccaggatttccataacattctctgaaatctgggtagaggctgccaaacatttatagctcttgctgtctgcaagcctgcagaattagtaccacgtggactctgccaaggtttataacttctgcagctgcagctcagctgtgcctggtgtggggcgcagagtcagaggcaaggagcctactacaaacctgcagggagccctccctggacctgtatcccagtactactctgccctcccaggcctgcaagcctgcgatgggaggggcagccccgaagatctctgaaatgccttctgggtctttcttccattctcttgatgatttctgctgtctgtaccaatctccttagcagatggtctctctaggccatactcttggattcctctcctgaaaatgctatttcacatggtcaggctgataaatttccaaatttttccactgtttcccttttctctggaagtttaccactggcagttagaagtaaccacacagcagcctgaacactttgccgcttagaaatttcttctatgggatattctattctgtcacttttaagttgacggcttttcacaaagccctagggtgtggccacgcagctgagttctttgctatggtgtagcaagggtgacctgtgttccagttcccaacaccttattcctcatttccatctgaggtctcattagcatggcctttgctgtcaacattgctatcaacattctggtcatgaccacttcaccaacctctaaggacttccaaactttccctagtcttcttatcctctaaggcttcaccagaatctaggcttttttctagcctatttttccaaattcttccagcccctgtccattacccagttcccaagcagcttccacattttcaggtatttgttatcagcaacacctcacttttcactaccaattttctgttttagtccattttctgttgcttatagaatacctagaatgagtaacttataaataaaagaaaagcattttgtacagttatggaggctgagatgtctcagggtgagggaccaaatctggtgagagcctttgcgccggtggggactctgaagattcccgaattgaggccacagggcatcacatggcaaggagactggttgtgctagctcaggtctctcttttcttgtatagccaccattaatccattaaccctttaatctgttgttccattaatggattgattcattactgaaggcagagcactcatgatcccatcacctcttaaagtcctcaccttttaatagtgccacattgggtattaactttccaacacatcaaatttggaggatacattcaatcataacgcagcagaaatacagcctagtttatttttctacaaatcaatttaatatctatttcaagtcccttttccaccagaagtggaatttggggctcaattcttctcttctttaattaaggttgtttacctagtgccaaggaaggaagcaggtctgctcttcaatgtcggccatccacataggcatctgccaagacatccatcatctagtctggttttcagagcttgagcatcatcagtccaaacaaggtgacactgagatgtcacaccacccaaaggcacaggcactctggggccattcaaatgataagtcatcatttgaatccctagatctagtctttgctgaagtttatgttttggaaatccttgttatattaataattcttattggtactatctttcttgcttcttcttgtaattttgcttgcctctctcttcttttctcaggtaggctctatgtacaacaagatcagcttctaggaaatctagccttgtatgttccttacatattgtaatcacaggaatagagaaacactctttcttccaacacacaaatcaagacaagataaaggactctgattgccccagttttggtaaattgcccacctctggccaattcttgagtcagaaagataagccactctgattggtcagctcagcctatgtgccatttcaggttaagtttcacagactcacatcttaaatcaaagattccattgagagtgatttcttaagttatgcttctgagagaaaacagtaagggagtggggaaagctagagaaggggaaaaaagtcttgcaatttccaaaacctgatatgggagctctagagcataaattatacctcctagcatgtcatcctggggcaaagaagccctgggtgtggagagattggaaggccatcaaacttccaggcactttcagctttacatgtagacaaggcagacccagtgcccaaggtccagcctccaaagggctcaggtgcaaagccttactggcaaagcacacaaaagctgggaatgggcttacaaaactggcaaaaaggaatcctgaagaatcgaagtggagcatccagtgtccactaaatttgctcagtgctttggtggggaagatacagtctcttgattaacgccaccaaaacattctcagggttagaagaagggcagttctcaagggtaagaatgtgaagccaaaaaaacaagtgaccacttgtatcattcaaagcctgagatagggctgttaaattttcctggagctacagtatttctgcacatttctccttttctcctaataattttttactgtaggtgttgatgttagtcaatacataaagttttataactgttataacttcactgtgcaatgtagtgttcatgataaaaataacccttcttttaaccatttagcgttttgaccgttgatatctatgtgtctgaaatcattaattacatctgtttttaaatgtcaccttataaatctttgtccaccctcttttttaaaaaaattatgtttgttttatggaagatatcacaaccaataccaaagaaatatgaaagtatattcaaggcttctatgaacacctttacatgcataatgtagaaaacctagaagagatggataaatttctggaaatttatcctagattaaaccaggaagatatagaaacactgaacagaccaataacaagaagcaagattgaaatggttaaaaaaaatgccaataaaaatagtccaggaccagaaggattcacagctgaattctatcaggcattcaaagaagaattggtaccaatcctactgacactattccaaaagatagagaaagaggaaattttccctaagtcattctatgaagtcagcatcacccttataccagaaccaggaagggacacaacaaaaaaagaaaactatagaccaatatccctgatgaacatagatgcaaaagtcctcaacaaaatactagtgagccaaatccaacagcatatcaaaaagataatccaccatgatcaactgggtttcagaccagggatgcagggatggtttaacataggcaagtcaataactgtgatacaccacacaaacagaattaaaaacaaaaatcacatgatcatctcaagagacacagaaaaagcatttgacgaaatccagcatccttttatgattaaaaccctcagcaaaattggcacagaagagacatgccttaaggtaataaaagccacctgcgagaaacccacagccaacattatactgaatggggaaaagtttaaaacattccccctgaaaactggaacaagacaaggatgcccactttcaccacttctagttaacatagcactggaagtcctagacagagcaatcagacaagagaaagaaataaagggcatccaaatcagtaaagaggaagtcaaactgtcactgtttgctgatgatatgatcgtatacctagaaaaccctaaagacatatccaaaaagctcctggaactagtaaatgaattcagcaaagtttcagggtacaaaattaatgtacacaaatcagtagctctgctatacaccaacagtgacgaagctgagaatcaaatcaagaactcaaaccctttcataatagttgcaaaaataaaataaaatacttaggaatatacctaaccaagaatgtgaaagacctctacaagcaaaactacaaaatactcctgaaagaaactatagatgacacaaacaaatggaaacacatcccatgcttataaatgggtagaatcaatattgtgaaaaataaccatactgccaaaagcaatctagagattcaatgcaattcccataaaaataccaccattagctgggcacggtggctcatgcctgtaatcccagcactttgggagtctgaggcgggtggatcgcctgaggtcaggagttcaagaccagcctggccaacatagcaaaactccgtctctactaaaaatacaaaaaattagctggacgtggtgttgggcgcctgtaatcccagctactagggaggctgaggcaggagaatctcttaaacccaggaggcagaggttgcagtgagctgagattgtgccattgcattccagcctggacaacaagaacaaaactccatctcaaaaaaaaaaaaaaccaccatcattcttcacagagttagaaaaaacaatcctcaaattcatatggaaccaaaaaggaacccacatagccaaagcaagactaagcaaaaagaacaaatctggaggcatcacaattacctgacttcaaactatattctaaggccatagtcaccaaaacagcatggtactgatataaaaataggcacatagaccaatggaacagaatagagaacccagaaatagagccaaatacttacagtcaactgattttcagcaaagcaaacaaaaacataaaacggggaaaggacaccctattcaacagatggtcctgggataattggcaagccccatgtagaagactaaatctggatcctcacctgtcaccctatacaaaaatcaactcaagatggatcaaagtcttaaatctaaaacctgaaaccataaagattctagaagataacaccagaaaaacccttctacacattggcttaggcaaagacttcatgatcaagaacccaaaagcaaatgcaacaaaaacaaagataaatagatgggacttaattaaagtaaaaagcttctgcacagcaaaagaaataatcagcagggttaacataaccaacagagtggaagaaaatcctcatctatccatctgacaaagaactaatatccagaatctacaaagaactcaaacaaatcagcaagaaaaaatgaacaatcccatcaaaaagtgggctaaggatgtgaatagacaattctcaaaagatgatatacaaatggccaacaagcatatggaaaatgctcagcatcactaattatcagaaaaactcaagtcaaaaccacaatgtgataccacctcactcctgcaagaatggccataatcaaaaaataatagatgttggcatggatgtggtgaaaagggaagacttttacactgttgattggaatataaactggtacaaccactgtggaaaacagtgtggagattccctaaagaactaaaagtagatctaccacttgatccagcaatcccactactaggtatttacccagaggaaaataagtcattatacaaaaaagatacttgcacacacatgtttatagcagtgcaatttgcaattgcaaaaatgtggaaccagcccaaatgcccatcaatcaacgagtggataaagaaaatttaatatatgaattctggctaggaggcttctcgttctgctcaaattgttacaaagttcagctagagaagaccttcccgtgaagttttaccccctgctcctctggccatcctcctgatggatgcctgtggtgccaggcaggaatgggctacttggggatccagcgagctccccgtgcctttctgctacttcctctacctctgtatttcactcagctcagctgtctaacttgactcagctctttcttagtgcctgaaacatctaaaagggaaaatccagaagaagacagagagaaactgagctcttgacaatgcattcactaaagaaagtgacctttgaagatgtagctattgacttcgcccagaagagtggagctttctcttgatggacatatccaagagaaagctgtacagagatgtgatgctggaaaacatcagtcacctggtgtccctcgggcatcagataagcaaatcctatataattttgtagctggaacaaagaaaagagctatggagggaaggaagagaatttcttcaaggccagagtccagacagggaaactgcccttaagaaaaaacacatgatatccatgcatcctatcatcagaaaagactcatccaccagtttgacaatggagaaatctctcattccagaggatccctttgaacataatgatttgggagaagattgcactcacagttccacaatgactccatgtttgttaactcacagtggaaagaaaccctacatcagcaaacagtgtggaaaatcctttagtaatcagttgtcccctaaacaacataaattcatactaaaggtaagtcatatcaacgtaatctatgtgaaaaggcttatactaatcgctttcaccttaggcagcacaagttgactcacactggagagagaccatatgcatgtcatctatgtgcaaaagccttcattcagtgttctcaccttagaagacatgagaaaactcacatgggagagagaccacataagtgtcatcagtgtgggaaagcctatattcaatccttaaaccttcaaagacattagagaacttaccttggaaagagatgttatgaatgtgataaaggtgggaaagcctttagtcagagctctggctttagagagcataaaaaaaatcacactggagagaaactacatgtatgtcttctatgtgggaaagccttcagtctatcttctgaccttagatgacatgagagaacatgcactggagaaaagccatttgaatgccatttatgtgtgaaagacttcagtcaatgtactaatcttaaatagcatgagaaaattcaccctagagagaaaattataaacatcttcagaacatattctgactttagatgacatggtgttaggaatgacgaatgtaaggaatgtggaagagacttcagctatagttgtaacatctaaacatgccaaaggactcaaatcttgaggaaatactgtaatcaacatggagtatacttcggttacgtttattcttcagtccacatcaatgaatggaagagaaattgtatggcatgtatgtagcaaagacttgttagtgatctgatcataaacgacatgagagagctgaaactgtcaacataataaactaaaagtcttaagcaacagctttgacttaaaacatgtgggactttcaggtagagaatctctagctctatatgtatacatggaatctctatatagagagtctctagctctatatgtatatatgtaacatatatacatatatgttacatatatacatatattgttggaaaaaagaaaatgtgtatatatatgtgttatatataacgtatatatatttcaatatttgtaagtattattttataattattttgtaagtattatttttgcattatttcaatatttgtaagtattgatcttttggaaaagtttaatgaaatttcttatataattctgcattcaatttattcccaggtcaatttgctattatacatttacatgccacatttttatgaatagacattttctcaaatttctgaattattttgctaaactatgtgctaagagttttttctagaggtccaccttcttgactcacttttctgatgagaaatctatcaggtttctctacagtgattttcaggtttgatagctcctcaatgtgagaaacttaatgtcaactaagaaatgaattaccactgaagagttttctcatttcaagatgctgactgtgttttgtccagtgtgaaatttgacatgtgccacaagtgttgctctatgaagaaaggatttctcatgatttttcattgcataatttctccagtaataagtatttggtatttcaagagaattcattgctctcggtaagattttcctttcttatttagcttataaaggctttcctctcttattttccattttagcaacattttatcactgtgttttcttgtgaacatcaaaactggtgcttggctgaatgtttagtcacagaaaatacaaataaagggttcatccaagtaaagctttcttatgttatttgacaataaattgcaaataaaaaacattttcacactgaatgcagagctagagattctctacctgaaagtcccacatgttttaagtcaaagctgttgcttaagacttttagtttattatgttgacagtttcagctctctcatgtcaattatgatcagatcactaacaagtctttgctacatacatgccttacaatttctcttccattcattgatgtggactgaagaataaaggtaactgaagtatattccatgttgactacagtatttcctcaagatgtgaggagatacatatacatatatatatacatgtatacacatatatatacatgtatacatatatacgtagtatataatcactgattatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacatgtatatacatacgtgtatatatatatatatacacacacacacacacacacaccatggaatactactcagccgtgaaaaaggaacaaaataatggcatttgctgcaacatggctggaattggagaccattattctaagtgaagtaactcagaaagagaaaaccaaatatcacatgttcccactcatctgtgggagctaaactctttggatgcaaaggcataagaatgatacattggactttggggacttgggggaaagggtggggggtgacaagggataaaagactacacattgataaagtgtacactgctcaggtgatgggtgcaccaaaatcccagaaatcaccactgaagaaattattcatgtaaccaaacaccacctgttcccccaaaacctattaaaataagtaaataataaatcaatcaataaataaaataaataaaattatgtttgttttagatgtgctttttggaagcagcaaaggttttttaagcagttgttttttaaccatatttggagaactctgttttaactgggtagtataactcatttaaatttattatcaggactgatatcatttgtgttgttatgctatctgcgggtattgtttcttttttctttcttgctgttttctttctatttttcaggtttctatgccacttcctctgttttctgtcatttgctctttgggttgattttatcttctgcagctttggaagatatcaactctcttttaagttctattgatattagtgtttaaaaattattctttttcattctttactaactttcacataagattttaaaaagtaactatctttttgctttctcccagttcacatttttctcacttagtcatagtctttcttcatgttatctggacattcagatccacattaatgtgatttgattctatatgtagtttttccactgtcttcttttaagaacaatttccaatgtttgcatttcatttttacaaccaaacttacaacaattatttaaatctaatgcgatggttgattttacgtgtcaacttgacacatattttttagtctactcttacattctgcaaaaccttctcaagtaagtccaccacatcactgattaaatttttttgttataacaagtctgcttttactaactacattgttgattttaattctattgcatttttcattttcatgacaatttcctcttctctggcagctgattttatctccagcacatttctgtacatttcacactactatgtctttaggttaatttctactctcctcttggctttctgttccagtttcataaagattatcttactgttttaataactgccaagatgtttaccaaaatattttcctggttctagtagtaaatcatttaaaaaatatgtactccctctctgaatcatcggagaaaaaaatcagcttttcttgtcattttctttttaaaagcatacacagaagtttttttccctctccaattccatgaaaaaagaattttttccatgtaaataccaacattcaaagtccatgatcctacctcaccccttaggcttttcttttctttttttttttttttttcttttttgagacaggttcttgctctgttgcccaggctgtagtgcagtggtacaatcttagctcactgccgccttaacctcccaggctcaagcctcccacctcagccacccaagtagctgggaacacaggtgcatgccactatgcctggcttatttatttatttatttatttattatttatttttgtagagacagggtctcaatttgttgctcaagctggtcttggactcctggtcttaagtgatcctcctgccttgacctcccaaagtactgggattacaggtgtgagtcactgtgcccagcccagccttttctttggagttaatagaattctctttttatgccatttcttggagataacttggcatgtaaatattctaattaaatcttcatgtcttacagggcttgagttggggtcttctcagacctaagctgtcaacttcaacttctttgaacttctcatcccacagaatatgtaaaattaatggtccaaagctttcctaatatctatgctaagtacatctagtttcttttaggactgcacttctctgtatgtaatgagtcactatcattcacactaccctctgcctaacatgctcgccaaaactccatatatcctgttgctatgatctaaatgttgatgtcccccagaaaaaccatgtgctggaacctaatgcctaatgtggtagtattaagaggtagcgccttttgaggaagtgattaagtcataaggatttcaacctaatgaatggggtcagtgctataacagagctgccttgccctttccaccacatgaggacacaataagaaggcatcatctttgaagcagggaaggagctaacatcagacactgaatctgttcatgccttaatcttgaacttcccagaccctcaaaggttgagcactaaatttctgttcctaaaccacccaacctaagattttttttatagcagcataaatgaactaagatagaaattggtactgagaagtggagtgctgctttaacaaatacctaaaaatgtggaagtggctttggaactgggtaatgagcagagtctggaaggatttggaggaagaggctgaaaaaaaaagcctgttttgctggaatggacagtaaagcgatattctgatattctggtgagggctcagaagaaaaggagagctgttaagaaacctcagtcttcttagactttatctaagtggttgtgaccagaatattgacagaaatatggatgttaaaggccattctgatgaggtctcagatggaaggaacacattgttagaaactgaagaaaaaaccattcttgtataaagtggcaacaacttggctgaattgtgtttatctcctagtgctttgtggaaggtagaacttggaaacgatgaaatatttggaagaaatctctaagcgaagtgcgaagagtgcagcatggcttggcttctgttgactgcttacactaaaatatgagaagagaaaaactaaccaaagatggaatttataacaaacaaggaagtagaccttaaagatttgcaaaattctcagcctggccatgttgtaaagaatgaaaaattgtgttcagggcgaacagcaagggtgtggccaagtcactatttgaaaaggatatttagtatggatgggcagaagcttgcttgcttctattcatcaaggcaatgggagaatgggcctgaaaacatttccgagatcttcagcagctgccctgtccattacaggcccagaataccagggccttgagaacagaaatatttcaaacttctgcccctctcattctggtgcagcactccttcaacccctcagctgtggctcaaatgggcccaagagcagctcaggtttctcctctgtgcagatgcacaggcagtaaaccttggtggcatctgcacagtgccacctcaccagagtgcttgagctgtgaggacatggctacctccacctagatttcaaaggattacccagagagcctcagagccactgcagagagtcctcactagagcaatgtctagaggagccatagaggcagagtctcttctgagaccccccaaaaatagagccaccagcaagcaactccaaacaatgacaactacagcatgggctgcacccggcaaagccatgagggcagggctgttcagacctgtgaggcccagcctctacccctgtgtgtctggaagatgagatatcaagtcaaagaagattattctggagtcttaaggtttaacgtttgccctattgggttttggatttggttggaacctgctatcccctttttaaaaaaaatccttccttttgaaatggaaatgtctatcctatgcctgtcccatcattgtattttggaagtatataacatgtttgatttcacagctggagagtaacttgcctcaggataaatcataccttgagtctcagccatatccgatttagttgatattaagatgagaccgagttttagacttttgagttggtactggaacaagttaaaattctgggggctattgggatggaacaaatatatgctccatgtgagggggccatgaattatagggggccaggaacagaatgtcatagtctaaatgttgacatccccccaaaattcacgttgaaacctattatctaatgtgatagtattatgaggtgcagccttttgggggagtgattaaatcacaatggctgtggcctcatgaatgggattagtgcccttacaaaagagatggaagtgcactgccttactttcttctatgtgaggacacagcaacaagacatcatctctagatcagagagtgaaccctttccagatactgagtctattggcactttagtcttgcactcctcagcctccagaagtgtgagcaataaatttctattgtttatccgttactcagtctatgatattttgtccagaagaactaagaaaactgtcttgtttttttctaaatgaatatataaagattacagttttaacatggatatataaagacagataccaatggaacaagacagggtttgaacaatcctctgaatacctcaaaaataatgcctgggttgtaaagaaacagccctcgtcactttttattcattggtagagaatcaaagttgtatttgagaggggagctgttagtagctttctctacctacttgcaagatgtaggtatattccatttcaagaggaaaaacaataaaatacaaacagatcaaaaccactcatactggccatgaattgtgaatggtgttattattatttgaataaccttaaaaaactgtcaggcttagttttcaatgttatgagtttttatcctcttctgtgtcttcataaatatacatatattttgagacagggtctcactatgctgtccaggttggtcttaaattcctgtgctcaagcgatgctcctgcctcagcctctggagtagctgatattataggcatccgtaaatatttttgcaaggaattcagagagttactgaaacaatacctgctagccagatgccatttaaatttaagactcttgctcaatatttaaaataatactgaaaaattaacattttattttttcttcttatcattattgttgttgtagttcttgctgcagagtaataatcatagctatgacttgttgagtattttttttaaatcaggcaggcattgtgagcacactgtatgaactttttctaattcttgtaatatcataattactaatctcactttccataaagaaattgaagttcaatgagtttagataacttgcccaaatcatactgctattaagttgtaatgctaagctcataatcaaatggctttgactccaatcccatccctgtctcacatgatgatacctcacccagcaaaggattctatggctataggaacacaactgccgtcattcccattgaattttttcttgcatgtaaatttcagcacaacaagcgttttttttaatagtacaacctgcacaagttgccaacaaatctcactagtaatatacatgggagaagaggagacagcaattgataatacaactaaatcaggtaaatcaatacaagatttttgatctagcattaatgtctgcacagatgcatgtttgatgtaagcctgtaatgctggttctggtagtaaaacgatagtattttttcaattcatcatgtaattaaatgaggtatttcctgcaaccaacttccttccttcagcaggatttaagctttttgatgaaaggatgttaactgtttgagggagcagagtttactatccacatcctttcagttaatacccagatttagaattattgagaacaaatgtttgaatcatctctataaactataaattagataattctataaaataattgattttaaaggaccagatctttaactctttaccacatttctcttccttgttttttctttttaaatctaaactctaaacagcatgtaaagtattgtaagagcttgcatttctacctcaaatatgccataaagggctctataaaaaaagaggctgaaaatatatactccactttaaaatgagtacacacataggttgttctgaatcgcagttggtaggtctttagagataaaagttattttaatgggttaaagcctctcctttcacctatgacaaaactataatctgtggtgagggatgtcaaatatattggtaaggtgctattaccacagaccctgcagacaacaaaaggtaataagggaatactatcaacaactctacacacaaatttggcaacttagataaaatggatcaatttcttaaaagtgcaaactaccacaactcactcagtatgaaactttgaatagccaaataactacttacaaaattaaattcataattttgagacttaaaaaaagaaaagaaagaaatctccaaccccagagagtttcactggagaatttgaacaaagagcgaaagaattagccccaattttacacaatttctccaggaaataaaagaagaatgaatgcttcttaattcattttgtgaaggtagtgttacactgataccaaaaccaaagacagcacacacacacacacaacacacaatgaactatagaccaatatctttcatgaatataaacatgaaatatttggaaaatagattcagtaatatctaaaaaaaattatatgctattacaaagtgtgatttatccctgggatgctagactgctttaatatttaaaatcaatcaatgtaatatgtcatataaaaattacatgatcatatcaactgatgaaacaaaatcatttggcaaaattcaacacccattcatgattttaaaaaaacaacactcagaaaaatagaaatacagggaagttttctcaatttgacaaagagcatctgtaagaaaacctacaatttccattatacttaatagtgaaaaactgaattctttccccctaagactgggagcaaggcaaagatcccactctctccactcttattcaacatagtgctacaagttctagccagcgcatcatggctagaaaatgaaataaaaggtatacagaccaaaaagaaagaaagaaaactgtttctatttgcagataacatgattgtttacatagaaaatcccaaggaatctgtaaaaagaactcctagaactaataaatgagttgagaaaagtcacagggtacaagatatacattcaaaaatcaactgttgtggagcacagaggattgggggcagtgaaaatattctgtatgatactatcttggtggatctatgcaattatacatttgtccaaacccatagaatgtacaacattaagagtgaaccttaatgtaaactacggactttgggtgacgatgtgtcagtgtaggttgatcagttgtaacaaatgcaccactctagccgggatgtcagtaacagaggagcctattatgcatgtgtaggagcagggggtatatgagaaatctctttaccttcctctcaattttgctgtgaacctaaatctgctgtgaaaaaaaaattgtctgtttaaaaattaattttatttccatatattagcaatgaacactgaaattaaaaatatgatatttacaatcactcaaaaaaaaagaaacaggtgtaaatctaacaaaacatgtataggatttacatgctgaaaactataaaatgctaaagaaaaaactccagaagatctaaataaatgagcagccaatgaggattggaagactcaacatagtaaatatgtcagttctccccaaattgatatacaggtttaatatatttcctatcaaaatcccagcaagacttttaataggtacagaaaaaattctaaaatataacaaaaatatagaggaactagataaaaaaggacaaattattccaaaaattatatatggaaaggcaaaataattaaaatagctaaaaaaaactttgaaaaagaattttaaaaacgggaagaaacagtctacctaattccgacattttatagctatagtaatcaagattgtgagttattgtaagtaagacagatatatagataaagggaacaaaatagagaaaccagaaataaattcataaattcacagaaatatgcccacttgactttagacaaacgtgcacaagcaattcaatagagaaaagatagtctttttttatttttggacacaaagtctcactctttcagccaggctggagtacaatggcaggatcatggcttactgcagccttaaccccccaggcccaagcaattctcccacctcagcctccttagtagctaggaatacaggcacacaccaacatgcctggctattttttaatttgttgagagacagggtctcactatgttgcccaggctggtctcaaactcctgggttcaagctatcctcccaccttggtatccgaaagtgttgagattacaggcatcagccactgtgcctgtccttaagatagccttttcaataaattgttccagaacaattagatatccataggccaaaaaaaaaaaaaaaaatgaaccttgaccaaagttaaaaattaactcaaagtggatcatgcacttgcatgtaaaatgtaaactataaaacttaaaaaaaacacacacaggggaaaatctttgggatctagggttaggcaaaaagtccctagacttgacaccaaaaatatgatctatgaatggaaaaaaatgatacattggacttcatcaaaatataaatctttggctctagaaaagactgagttaagaggatgaaaagtcaagctacaggctgagagaatatatttacaaatcacatggccaccaaaggactagtatctggaatacaaaaagaactctcaaaactcagtgtaaacactcaatccaattagaaatgaatgaaagtcataaatggaaacttcactgaagaggataaatagatggtaagtaagcacatgaaaatatgtgcaacttcatcagcccttaaggctgtgtgaactaaaatcacaatgaaataccactgcatacctatgagaacagctaaaataaaaaatagtgacaacaccaaatactagtgagggtgtgaagaaactggatcactcaggtgtcactgcttgggatgtaaaatggtacagccactctggaaagcagtttagtagtttagcagtttctttaaaaactaaacatgcaactaccctatgatctaccaattacactcctgggtatttattccatataaatgaaactttatgttcacacaaacacctgtaaaagaatgtttatagaagatttatttgcaatagccaaaaagtagaaacatcagacatggtggctcacacctgtaatctcaaccactggagaggctgaggcaggaggattgcctgaggctgggagagatttgtcttggcaacatagcaagaccgtgtctctaaatagtttttttaattagcagggtgtggtggtgtctgtaggaccagctacttgggagactgaggtgagaggattgcttgagcctagaagttcaaagctgtagtaaactacaatcatggcaacctgtatacttcaacctaggcaacagagagacatctggtctctaaaaaaacaaaaaaagtagaaacagctcagatgttcttcaatgtgtaaatgggtatacaaactggaacagctgtaccataaaatactacccagcaataacaaagaatgaactgttgatacacacaaccacctggatgaatctccagggatttgtactaagtgaaaaagaaacaattctgaaagatcatacattgtataattatattcacatatctgatgtaacaaaattatagaagtgaagaacagattagtgactgctaagggttaaagagggatggaagaggaagagaagtgggtgtagctgtgaaagagcatcaggagagagcctgtagtgatggaaatgttctgtatcttgaatgtatcagtgtcaacatcctggctataatattgtactatagttttgcaaaatattacattgagggaaactaggtgaaagctacacaagatctctgtgtattcttcctcacagttgtatgtgaatctacagttgcgtcaaaatgaaacataatttttttaaaaaagggtaagaaggaaatattatgaacacttttatgactacaaattcaataacttagaggaattggcaaatttttttaaagacattaactaccaataatcactcaagaaaaatagagagtatgaagagtggaatatctattaaactgaaattatactttaaaatcttttaacaacaaccaaaaaatccaggtaaagagagcttcactagagaagtttactaagcatttgtagaaagaaaaaataatgcaatatctatacacaaacacacagacataaaaaaatggaagagagaaaaaatggcagataggagtcagaactaacttgcagctcttacccagatggacagaacagcatgtggagactcatattgtgaacttttactccaagagctactgcaggaagataccaggaatactaaaagaattcacagatcctttgaaagaagaggcttgctgctacaaactctgtgagacagccaaaaaactgtgagtatccaaagtgtgagagaaggaaagtccgcttccaaatacacatcctcactgggaaacctgaaaatccagatcatgggagtaggatttaaccttacctagagctgaaactagagagccaagagaaatagaaacgtaaacaaagcagcagggagagccctgtaggaactccctgcttccagggaagcccagggaagccatttctgactttatctcacaggggtcttttgggagggctcccagtggaattggggaaagaccacaaggagaaggaaacttccagctgaccttcataataatttcagccaagcgtaaattgtcctgggcagacaggaagtgcagacaggagcacagaagtcatggcaggtgaggagggttggagcctgaaatccctgcttgctttctcagcaaggaggcttgtagcctggggcaagatctcagtcttactcactggctgcctggatataaaatcagtgctggtggggcatggcgggagtgagacgggccttgctggctgcatgggagctgggtgagacctgtcactgctggctttcctctacttccctggtgacctgtgtgatgtatgatgcaggagaggcagccataattcccttggaacataactccattggcctgagaaccacacctgcatctcctattatagccatagcaagccctgcccaaggagagtctgagctcagacatacctgaccctgccctcaacagatggtctttctctacctgccttggtagccaaagacaaaagacataatctcttaggagctctatggacctgcccatcacctgagagacctgaatatttatccaggtgaccatagcgcaagctagcatcccacctatactacaccctccttagggtaggctggtttgcccccatattatccccccatagtactcttttgaaagcaccacctcctgactggaggtgaatcaactcaagctattacaacccttataaaagaacaaccctgctccaacaaagaagacaacagctaattacatggtctgtaacatcatggctaaccagaggtcctgagtctgtccacatgacaactttaccactagcacaaccagcacttgagaaaaccagttcactgaacaaaactacaaccaaggacccttacagagtccacttcactcctctgttacttccactggagcaggtgctggtagccacagctgagatacctgaagactgatcacatcacaggactctttgcagacactccccagtactagcctagagcccagtagctccaatgggtggctacacccagaagagcaaaagcaatcactgcagtctggctctcaggaagcctcatccctaggtgaatgaagagagcaccatatcaagggatcaccctgtgagacaaaagaatgtgaacagcagcccttgagccccagatatttcctctgacacagtctacccaaatgagaaggaaaaagaaaaacaattctggtaatatgacaaagcaatgttctttaacaccccaaaaaagatcacactagctcacgagcaatgggtccaaaccaagaagaaatctgtgaattgccagaaaaggaattcagaagattgactattaagctatccaaggaggcaccagagaaagatgaaaaccaacttaaagaaaatttaaaaataatacaggatatggatgaaaaaatttccagggaaatagcataaataaaaacaatcacgacttctggaaatgaaacacacacttagagaaatgcaaaatacactggaaagtgtcaacaatagaatcaaacaagtagaagaaggaacttcagagctcaaagacaaggcttcagaattaaaccaatctgacaaagacaaagaaaaaagaatttttaaaaaatgaacaaaggctccaagaagtttgggatcatgttaaatgaccaaaccgaagaataattggtgcccctgaggaagaagaaaaatctaaaagtttgggaaacttatttgagggaataatccaggaaaacttttctggtcttgttagagatctagacatccaaatacaagaagctcaaagaacacttaagaaattcatcgcaaaaagataatcaccgaggcacagagtcatcaggttatctaaagtcaagacaaaagcaagaatcttaagagctgtgaggcaaaagtatcaggtaaactataaaggaaaacctatcagattaacagtagatttctgagcagaaaccatacaagctagatgggattggggtcctatctttagcctccttggacaaaacagttattagccaacaattttgtactcagaaaaactaagcttcataaatgaagaaaactcttttttagaaaaacaaatgctgaatttgccactaccatgccagcaatacaagaactactaaaaggagttctaaatcttaaaataaaaccttgaaattcgataaaatagaacctccttaaagcattaatctcatagggcctataaaacaataacacaatgaaaaaaaacttaggcaacaagtagcacgatgaataaaatagcacctcacatctcaatactaatgttgactgtaaatggcctaaatgcttcacttaaaagatgcagaatgccagaatggataagaattcaccaaccaagtatctgctgtcttcaagagagtcaactaacccataaggactaacataagcttaaggtgaaggggtagaaaaagaagttccatgcaaatgaacaccagaagtgagcaggagtagctatccttatatcagacaaaacagacattaaagcaacaacagttaaaaaagacaaagagggggtcctggtacgggacatgtgagaggtatgctccaacttccagtttctgtggaaattcagtagagagataaacgttgttttcatcaagggtttgtaccagctattatttcttcctgaaaaacaaacaagcaagtttctgtggatcaggaatttgggagcagatcagctggaggactctgactcaggatgtctcataaggttgcaatcaagacatcagctaggactgtaatcatctcaagaaaataaagatccattccaagatggccgaataggaagagctctggtctgcagctcccagtgtaatcaacccagaagaagggtgatttctgcatttccaactaggtatctggttcatctcattgggactggttggacagtgggtgcagcccacagagggtgaactgacgcagggcgtggtgtcaccttagcagggaaatgcaagggatagagggatttccctttcctagccaagggaagccgtgacagattatacctggaaaaacgggacactcccacccaaatactgcgcttttccaaagtcttagcaactggcagacaaggagatactctcccacacctggcttggcaggtcccacgcccagggagccttgctcactgctagcacagcagtctgagatcaaactgcgaggtggaagcctggcggggggaggggcgtccaccattgctgaggcttgagtaggtaaacaacgtggctggggagctcaaaatgggtggagcccaccacagctcaccaaggcctgctgcctctagactccacctctgtgggcagggcttagctgaacaaaatgcagcagacaacttttgcagacttaaatgtccctgtctgacagctctgaagagagcagtggttctcccaacatggcgtttgagctctgagaaccaacagactgcctcctcaagtgggtccttgacccccgtttagcctaactgggagacacctcccagtaggggagtgcccctctgggacaaagcttccagaggaaggatcaggcagcaatatttgctgttctgcattatttgctgttctgcagtttccactggtgacacccaggcaaacagggtctgcagtggacctccagcaaactccaacagacctgcagctgagcaacctgactgttagaaggaaaactaacaacagaaaggaatagcatcaacatcaacaaaaaggacatctacaccgaaaccccatctgtaggtcaccaacgtcaaagaccaaaggtagataaaacaacaaagatggggagaaaacagagcagaaaagctgaaaattctaaaaatcagagcgcctcttctcctccaaaggattgcagctcctcgccagcaacagaacaaagctggactgagaatgactttgacaagttgacagaagtaggcttcagaaggttggtaataataaacttctccgaactaaaggagcatgtttgaacccattgcaaggaagctaaaaaccttgaaaaaaaggttagatgaacggctaactagaataaacagtgtagagaaaaccttaaatgacctgatggagctgaaaacccatggcataagaacttcatgaggcatgcacaagcttcaatagctgattcaatcaagtggaagaaagggtgtcagtgactgaagatcaaattaatgaaataaagcgagaagacaaggttagagaaaaaagagtaaaaagaaatgaacaaagtgtccaagaaatatgggactatgtgaaaagaccaaatctacatttgattggtgtacctgaaagtgatggggagaatggaacaaagttaaaaaacattcttcaggacatgatccaggagaacttccccaacctagcaaggcaggccaacattcaaattcaggaaacacagagaacaccacaaagatactcctcgagaagagcaaccccaagacacataattgtaagattcactaaggttgaaatgaaggaaaaaatgttaagggcagccagagagaaaggtcaggttacctacaaagggaagcccatcagactaacagcagatatcttggcagaaaccctacaagcgagaagagagtgggagccaatattcaacattcttaaagaaaagaattttcaacccagaatttcatatccagccaaactaagcctcataagtgaaggagaaataaaatgctttacagacaagcaaatgctgagacattttgtcaccaccaggcctgccttataagagctcctgaaggaagcgctaaacatagaaagaaacaaacagtaccagccactgcaaaaacatgacaaattgtaaagactactgatgctaggaagaaactgtatcaattaatgggcaaaataaccagctagcatcataatgacaggatcaaattcacacataacaatattaaccttaaatgtaaatgggctaaattctccaattaaaagacacagactggcaaattggatagagtcaagacccatcattgtgctgtatttaggaaacccatctcacgtgcagagacacacataggctcaaaataaagggatggaggaagatctaccaagcaaatggaaagcaaaaaaaaagcaggggttgcaatcctagtctctgataaaagagactttaaaccaacaaagatcaaaagagacaaagaaggccattacataatggtaaagggagcaattcaataagagctaactatcctaaatatacatgcacccaatacaggagcacccacattcaaaaagcaagtccttagagacctacaaagagatttagactccgacacaataataatgggaggctttaacaccccactgtcaatattagacagatcagcaagacagaaggttaacaaggatatccagcacttgaactcagctctgcaccaagcatacctaatagccatctgcagaactctccaccccaaatcaacagaatatacatacttctcagcaccacatcgcacttattctaaaattgaccacataattggaagtaaagcactcctcagcaaatataaaagaacagaaatcacaacaaactgtctctcagaccacagtgcaatcaaattagaactcaggattaagaaactcactcaaaaccacacaactacatggaagctgaacaacttgctcctgaatgactactgggtaaataatgaaatgaaggcagaaataaaaatgttctttgaaaccaatgacaatgacaacaaagacacaaagtaccagaatctctgggacacatttaaagcagtgtgtagaaggaaatatagagcactaaatgcccacaagagaaagtgtgaaagatctaaaaccaatacccttacatcataattaaaagaactagagaagcaagagcaaacacattcaaaagctagcagaaggcaagaaataactaagatcagagcagaactcaaggagatagagacacaaaaagcccttcaaaaaatcaatgaatccaggatttggttttttgaaaagatctacaaaattgatagaccactagcaagactaataaagaagaaaagagagaagaatcaaatagacgcaataaaaaatgataaagggatatcaacaccaatcctgcagaaatacaaactagcatcagagaatactataaacatttctatgcaaataaactagaaaatctagaagaaatggataaattcctggacacatacaccctcccaaaactaaaccaggaagaatttgaatctctgaatagtacaataacagtttctgaaattgaggcaataattaatagcttaccaaccaaaaaactccaggaccaggtggattcacagccaaattctaccagaggtacaaagaggagctggtaccattccttctgaaattattccaatcaatagaaaaagaaggaaccctccctaactcattttgtgaggacatcgtcatcctgatatcaaagcctggcagagatataacaaaaaaagagaatttcagaccaatatccctgatgaacatcgatgtgaaaatcctcaataaaatactggcaaactgaatccagcagcacatcaaaaagcttatccaccatgatcaggttggcttcatccctgggatgcaaggctggctcaacatacacaaatcaataaacataatccaacacataaacagaacgaatgacaaaaaccacatgattatctcaatagatgcagaaaaggccttcaaaaaaattcaacaacccttcatgctaaaaattctcaataaactaggtattcatgtaacttatctcaaaataataagagctatttatgacaaacccatgcaaatatcatactgaatggccaaaaactggaagcattccctttgaaaactgccacaagacaaggatgccacctctcaccactcctattcaacatagtgttggaagttctggccagggcaatcatgcaagagaaagaaataaatggtattcaattaggaaaagaggaagtcaaactgtctctgtctgcagatgacatgattgtatatttagaaaaaccccatcatttcagccccaaatctccttaagctccagcaaagtctcaggatacaaaatcaatgtgcaaaaatcacaagcattcttatacaccaataacagactaacagagagccaaatcatgagcgaactcccattcattgctacaaagagaataaaatacctagaaatccaacttacaagggatgtgaagaacctcttcaaggagaactacaaaccactgctcaacaaaataaaagaggacacaaactaatggaagaacaacattccatgctcatggataggaagaatcaatatcatgaaaatggccatactgcccaaggtaatttatagattcaacgccatccccatcaagctaccaatgactttcttcacagaattggaaaaaactactttaaagttcatatggaaccaaaaaagagcccacattgccaagaaaatcctaagtaaaaagaacaaagctggaggcatcatgttacctgacttcaaactgtactacaaagctacagtaaccaaaacagcatggtcctggtgccaaaacagatacatagaccaatggaacagaagagaggcctcagcaataatgccacatatctacaaccatctgatctttgacaaacctgacaaaaacaagaaatggggaaaggattcctatttaataaatggtactgggaaaactgactagccatacgtagaaagctgaaacagatcccttccttacaccttatacaaaaattaattcaagatggattaaagacttaaatgttagacctaaaaccataaaaaccctagaagaaaacctaggcaataccgagaggtgacagcgtgctggcagtcttcacagctctcgctcgctctcggcacctcctctgcctgggctcctactttggcggcacttgaggagcctttcagcctactgctgcactatgggagacttcttctgggctggccaaggccagagccggctttttcagcttgcagggaggtgtggagggagaggcacgagcaggaaccagggcacttgcgggccagctggagttccaggtgagcatgggcttggcaggccccgcactcagaacagccggccggccctgccggccctaggcaatgaaggacttagcacccgggccagcgcctgcggagggtgtactaggtcccccagcagtgccagcctaccggtgctgcactcgatttctcgccaggccttagctgccttcccacaggacaggcctaaggactgcagtcccccatgcctgagccttcccccgcctccgtaggttcctgtgcagcccgagcctccccgaggaggagcaccgccccctgctccatggcacccagtcccatcaaccacccaagggctgaggagtgcaagtgcatggcgcaggactggcaggcagctccacctgcagccccagtgcaggatgcactaggtgaagccagctaggctcctgagtctggtgaggacatggagagtctttatgtctagctcaaggattgtaaacacaccaatcagcaccctgtgtctagctcaaagtttgtgagtgcaccaatcaacactctgtatctagctactctggtggagccttagagaatctttatgtctagctcaaggattgtaaatacaccaatcggcactctgtatctagctcaaggtttgtaaacacaccaatcagcaccctgtgtctagctcaaggtttgtgagtgcaccaattgacactctgtatctagctgctctggtagggccttagagaacctttacgtctagctcaaagattgtaaatacaccaatcggcactctgtatctagctcaaggtttgtaaacacaccaatcagcatcctgtgtctagcttaaagtttgtgaatgcaccaatcgacactctgtatctagctgctctagtgaggccttggagaacctttgcgtggatactgtgtatctaactaatctaataaggacgtggagagcctttgtatctagctcaaggattgtaaacgcaccaatcagcgccctgtcaaaacagaccactcggctccaccaatcagcaggatgtgggtagggccagataagagaaaaaaagcaggctgcccgagcctagcagcagcaaccggctcaggtccccttccacactgtggaagctttgttcttttgctctttgcaataaatcttgctactgctcactccttaggtccacgctgcttttatgagctgtaacactcaccgtgaaggtctgcagcttcactcctgaagccagcaagaccactagcccaccgggaggaacaaacaacttcagacgtgctgccttaagagctgtaacactcaccgcgaaggtctgcagcttcactcctaagccagcgagaccacaaacccaccagaaagaagaaactccaaacatatctgaacatcagaaggaacaaactccagacgcgccaccttaagagctgtaacactcaccgcgaaggtccacagcttcattcttgaagtcagtaagaccaagaacccaccaattccagacacaataccattcaggacataggcatgggcaaggacttcatgactaaaacaccaaaggcaatggcaacaaaagccaaaattgacaaatgggatctaattaaactaaagagtttctgcacagcaaaagaaactaccatcagagtgaacaggcaacctacagaatgggagaaaatttttgcaatctacccatctgacaaagggctaatatccagaatctacaaagaactcaaacaaatttacaacaaaaaaaacaaccacatcaaaaagtgggcaaaggatacgaacagacacttctcaaaagaagacatctatgcagtcaacagacacatgaaaaaatgctcatcatcactggccatcagagaaatgcaaatcaaaaccacaatgagataccatctcacaccagttagaatggcaatcattaaaaagtcaggaaacaacagatgctggagaggatgtggagaaataggagcgcttttacactgttggtgggagtataaattagttcaaccattgtggaagacagtgtggcgatccctcaaggatctagaaccggaaataccatttgacccagcaatctcattactgggtatatacccaaaggattataaatcatgctactataaagacacatgcatagacatgtttattgtggcactattcacaatagcaaagacttagaaccaacccaaatatccatcaatgatagactggattaagaaaatgtggcacatatacaccatggaatactatgcagccataaataaggatatttattataaaataaaagttcatgtcttttgcagggacatgaatgaagctggaaaccaacattctcagcaaactaccacaaggacagaaaaccaaacaccacaggttctcactcatcggtgggaattgaacaatgagatcacttggacacagggcaggggatattacacactggggcctgtcgggggatgggggttaggggagggatagcattaggagaaataattaatgtaaatgacgagttgatgggtgcatcaaaccaacatggcacatgtatacctatgtatcaaacctgcatgttgtgcacatgtaccctagaacttaaagtataataattaaaaaaaaaaaaaagaaaatgggggtggggaggacagagagaggaaagaaggagtcaaaaggagggaaaaaggagtggggaataaaataattctcatgtttaagagggacattatataatgataaaagaactagtccaaagggaaaatatcacaatcctaaatatatatgcacctaacactgaagctccaaatttaataaaacaattactactagacctgagaaatgagatagacagcaacacaataatagtggggactttaatactccactgacaccactggataggtgatcacgacaaaagtcaacaaagaaacaagacttaaagtataacccagaacaaatggacttagcagatatttacagaacattctacccagcaactgcagaatatatattccattcatccacacatggaacattctccacgacagatgatatgataggtcacaaaacaagtctcaataaagttaagaaaatcaaaattatatcaagtactccctcataccacagcaaaataaaattggaaattaactccaaaaagaacctcaaaactaaacaaatacatagaaattaaataatctgctcctgaaggttctttgggtaagcaatgaaatcaagatggaaaataaaaaattatttgaacaataatagtgacacaacccgttaaaacctctgggatacagcaaaagcagtgctaagaggaaagttcatagcattaaatgcctacatcaaaaattctgatgtaggcatcagacaatctaagctcacacctcaaagaacaatagaaacaagaagaaaccaaacaaaccaaacccaaacccagcagaagaaaaaaaaaaataactaagatccaagcagatctaaatgaaattgaaacaaaaatgcaaaacataagtgaaacaaaaagctgtttacttgaatagataaacaaaattcgtacaccattagtgagattaaccaataaaagaagatccaaataagctcaattagaaatgaaatgggagatattacaacagataccacagaaatacaaaaggtaattcagggttactatgaacacttttatgtgcacaaactagaacacccagaagagatggataaattcctggaaatacatgctcctagattgagccaggaagatatataaactctgaacagatcaataacaagcagcgagattgaaatggaaacaaaaaaaaattgccaacaaaaaacagtccaggaccagacagattcgcaactgaattctatcggaaagtcaaataagaattggtaccaattttaatgaaactattccaaaagatagaaaaagagggaatctttcataaatcattctatgaagccagtattatcctaacaccaaaaccagtaaaggacataacaaaaaaaaggaaagctacagaccaacatccctgatgaacatagatgcaaaaatcctcaacaaaatactagtgaaccgaatccaacagcatatcaaaaagacaattcgccataatcaagtgggtttcataaaagggattcagggatggtttaacatacacaagtcaaaaaatgtgatacaccacatgaacagaattaaaaacaaaaattgcatgaccatctcaatagatgcagaaaaaaaaactgacaaaagccagcatccctttatgattaaaaccctcagcaaaatcggcatagaagggatataccttaaggtgataaaagtccccgcagccaacattatactgaatggggaaaagtttaaagcattccccctgagaactggaacaagacaaggatgcctgctttcaccatttgtattcaacatagaagtggaagtcctagccagagcagtcagacaagagaaagaaagaatgggcatccaaatcagtaaagaggaagtcaaactgttgctgttcaccaatgatataatcacatacctagaaaaccctaaaaatgcatccaaaaagctcctagatctgataaataaattcagtaaagtttcaggatacaaaatcaatgcatacaaatcagtagcactgctatacaccaacagcaaccaagctgagaatcacatcaagaactcaatcccttttacaatacctgtaaaaataaaataaaatacttaggaatatacctaaccaaggatgtgaaagacctctacaaggaaaactacaaaacactgcagaaagaaatcatagatggcacaaacaaatggaaaacacatcccatgctcataattgggtagaaccaatattgtgagaaataaccatactgccaaaagcaatctacagattcaatgcaattcccataaaaataacaccatcattcttcacagaattagaaaaaaaaatcctaaaattcatatggaacccaaaaaagagcctgcatagccaaagcaagactaagaaaaaagaacaaatctggagggatcacattacctgacttcaaactatactctatggccatagtcaccaaaacagcatggcactgaaaaataggcacatagaccaatggaacagaatacaaaacccagaaataaagccaaatacttacagtcaactgattttcagcaaaggaaacaaaaacataaaatggggaaaggacacccttttcaacagatggtcctgggataactggcaaaccgcatgtagaagaatgaatccagatcctcatctgtcaccctatataaaaatcaactcaagatggatcaaagaattaaatctaagacatgaaaccataagatgctagaaattaacatcagaacaacttttctagacattagcttaggcaaagacttcatgaccaagaacccaaaaggaaatgcaacaaaaacaaagataaatagatgggaataaactaaaaatcttctgcacagaaaaaggaataattagcagagtaaacagacaatccacaggtggtagaaaatatttgcaaactatgtgtgatgattaatattgagtgtcaacttgattggactgaaggatttaaagtattgttcctgggtgtgtctgtgagggtttggccaaaggagattaacatttgagtcagtgaactgggagaggaagactcatcctcagtgtgggttggcaccatctaatcccaccatatgaagaaggatgtgtttgcttccccttctgccatgattataagtttcctgaggcctcctcagccctgcagaactgtgagttaattaaacccctttcctttaaaaattacctagttttgggtatttcttcatagccgcgtgagaatgaactaatacactatgcatccaacaaaggactaatacccagaaactataaaaaactccaacaaatcagcaagaaataaaacaaataatcccataaaaaagtgggctaagggcatgaatagacaattctcagaagaagatatacaaatggccaagaaacataggaacaaatgctcaacatcactaatgatcagggtaatgcaaatcaaaaccacaatacaaaaccaccttactcctgcaggaatggccacaatttaaaaaatcaaaaaataatagatacaaaaccaccttactcctgcaacaatggccacaattaaaaaatcagaaaataatagatgttggcatggatgtgctgaaaagggaagacttttatactgctggtgggaatgtaaactagtacaaccactatggaaaacagtatggagattccttaaaaaactgaaagtagtcctaccatctgatccagcaatctcactgctgggtatctacccagaggaaaagaagttgttatatgaaaaagatattcgcacatgtaggtttatagcagcacaattcacaattgcaaaaataggaaccagctcaaatacccattaatcaacaagtggataaagaaaatgtgagatatacatagatagatgatggatagattagatagacagatagatgattgatagatagatagatagatagatagatagatagatagatagatagatagaaaatggaatgctactcaaccataaaaagtaacaaaataatggcacttgcagcaacctggatggaattggagaccattattctaagtgaaataactcatgaatggaaaactaaacatcgtatgttctcacttataagtgagagctaagctatgaagacacaaaggcataaaaatgatacaatggactttggggactcagagggaagggtggaagagggggtgaaggataaaagaatacacgttgggtacagtgtacactgcttgggtgatgggtgcaccaaaatctcagaaatcaccactaaagaacttatccgtgtaaccaaaccccacctgttacccaaatacctattaaaatattttttaattagaagaggagagaacacttttcaattcattctaaaatgctaacattatcctaaggccaaaacaagataaagacattacaagaaaataaaactaccgacaagtatccttaataaacatagatgcaaaagtgctttacaaaattttggcaaattgaattcaacaatatataaaaaggataatatgaataacagctgggagatatcctaggaatgcagcattcatttgacattcaaagatcaatgaatttcaatatattaacaaactaaaaaagaaaaataatatgaccgtatcaattcaggcagaaaacacatttgacaaaagccaacacattaatgatatttaaaaaaaaaatctcacccaagttgaaatagaaggtaacttccttatcctgacataggacctctacaaaaacttagatcaaacatcatacttaataggaaaagatttaatgcttttcctttaaaattgggaataaaacaaagatgtctgtttgcaccacatctattgaacattgtaccagtgattctaactggcgcaatcaggcaaaaaaaaaggaaataaagggcatctaggttaaaaaagaagtaaaactattttattcacagatgacatgatcatctaggtagaagatccaatcaaatttacaaaaaaaaacctactagagtaatgaatttatcaaagtagcaagatgcaggatccataaataagaatcaattgtatttctatatattagcaatgaaaaactgaaattaaacattaaaattgtattttatttttctgagacagagtctcactctgtcacccaggctggagtgtagtggcgtaatcttggctcattgcaacctccgcctcccaggttcaagtgattctcctgcctcagcttcccaagtagctgggactacagctgcacaccatcatgcccagccaatgtttgattttttttttttagtagagatggggtttctccacattggccagtctggtctcaaactcctgacttcaagtaatctgcccacctcagcctcctaaagtgctgagattacaggcgtgagccactgtgcccggccttaacattaaaattttaaaacactatttaaatagcactaagaatataaatacttaaggataaatctgacaaaagatgtgaaagtcctaaatagagaaaaacatacaacacaactatgagaaattaaagaatgtccaagtaaatggagacacataccctgttcatgagacaaaaaactcattattatgatagcagttcttcccaagttgttctggagatttaatgcaatccaaatcaaaaccctaacaaacttattgtagaaattgacaagctggttctaaaatgaattcagaaatgcaaaggacctagaatagccaaaacaaccttgaaaaagtgaacaaagttggaggactaacacttcctgatttcaagacttattgtaaagctataaagtaatcaaaaaggtgtggtattatcatatagatagagaaaagatcaatggaacaaaatagagtccagacatacagatacaactgatttttaacaatttgcaaaggcaatttagtgaagaaaggatagttttttttttcaacaaatgctgcagaatcagttggaaatcaataatctaaaaagaaaaaacttcaatccatatcttgtaccactatatgcaaaacttaactcaaaatgtatcatagacctgaatttaagtcctcaaactacaaaagttctagaagaaaatagaggagaaaatcttagtgagtttgagtcaggcaaagagtatgtggatacaacactgaaaccacaatgcagtaaaaaactgacaaattatacttcatcaaatttaaaatcttctctgcaaaagaggatgaaaagacaagtcacaggctaaaaaatatgtatttgcaaatcatatatctggtaaaatacttttatccagaatataaaatgaactctcaaaattcaataataagaaaaaaaatacaccaaaagtaaacaaaacatttgaacatgcatttcaccaaatggcaaataagcacataaacagatgcccatcatcattagtcattagggtaaagcaaagtaaagcacaatgagataccactaaacatatcaattgagacgattaaaataaaaaagactgaccataccaaggattgcaaatatatgaaggagctagaactctcatttcctgtagtgggaatataaaataatatactctttgggagaacagtctgcagtttcttaaaaagttacatgtatgctaactatacgctctagccatttcacttgtaggtatttcccatgacaaaagaaagtatatgtctatataaacagttaaatagttacacacaaatgttttagtggttttattaatatatcccaaaactggaaacaacctaaatgtctatgaacaggaaaatggataaataaattgtgactatctatacaatggaatgctactcaacaataaaaaggaattaactactgatacaacaaggtggatgaattttaagataatcatgctcaatgaaagaagtcagataaaaaatagtacctactgtatgattccatttatatgaaactctagaaaatgcaaactaatctatgacagaaagcaaatcagtggttgcttaggaatgtggaggagtgaggaatggaaatgaggaactgcagagggccatgagaaaacttttcagctgatgcacatggtcactgtctttattatggtgatggtctcatgggtatatatatatatcaaaaacaactctctctctctctctctctccaatcccccaaccccatctcttacaacaagaaagtatgtccctagtatatctggaagccatcttttgaccaagagaaaagccagcatgaggaaactgttaacacagggacagaagaaaagaaaatgtctctgaagggaagagagccagaattgtgattacattaaacctaaagattttcaacgatgtgacctgatgaaattccataatggttaagtcattttgagtcataattttacatcttttcaccttaggtgaaaagcatcctaaccaagataagtatatgctcagcattatattgataatttataatacgccattggaaaaaaactctcttcctggcatttaattatattacttatttcaaagaaaatgcagtaaaaaactgatctgtatatctactgatatgtctatcagtaaaacagataagtatatctatgtatacctactatgcataagccttacaggtgctacatagaggtgatatctgttgtttatactctttgtcttcccttcttcctttttttgataacagtgccccaatttacgcttagctaaccataatctagcattactaattcatgtcttccagatgagatagaccctccttgtcactaaaagtagacatgtgactcacagcattgtaagaagatagtaatggaacacaggtccccaaatttaccctcccaatctcttctcaattactttccccaacaagaaaaaatgctactgcaggtaagcaggggcatctaaagcagggtcacttgaggtcacaggctccagggtctctaaaaggaaagagatactctcactcttctctgttttaggtagtctggagggccttgttatagaaagacttaaaacaaaggtctcaattttatggcttccagtgaaagttagcctgaggaaacctatgaatgccttcaggaaagcattacatgggcttatttgtgtgtgttcttgggaaggtcagactaatctgggtagtgacaggtcatatggaggaacgctgcactcatggaagagttgcttgtagcccctgaggttaggcaagcattctcccttgcacccagggagctctgggagaagaaagactttttttaaagcttcagctgggtgtggacagattgccagttggtttactgccagcccacaaaagcagaaacctttcccctggcaggtttgccactgcataaaagaccctaactacttgtcctgtaattataggtcagtgtatacagagcctgaggtctgaacaggaaatggaaaataataacttgccctagtagtactagcaagccagagaggaaaactaagataaacacttcaaacaggtgttttgttgaaatagaactgttagaagagccaggtgaaaacttttctaaaaagtaataaattcactcaagaagatataattaaagattaggagttaaatatatgatagatgctagaatgataaaatatacatattttaaaaataggtaatgactccatgtgtttctgacagtatacccttcctggttgaaataactaaaatgaaataactaatggaaataactgaaatgctacataacatatttttaaaaattaatactgcttagccggcatgaaattcaggaatctaaatatttccaaaactgaaaaactggagggaatagctgagaaattgacttagtctgttttgtgttgctatcacagaaaaccacagactgggtaatttataatgaaaagaaatttgtatctcacagttctggaggctgggaagtccaatatcaaggtgccagcatcttgtgaaagctttcttgctacatcatcccatagtgaaaggcagaagagcaaaagagcagacactcaagagagaaagtaacctactcctacaataatggcattcatccatttatgggggtagagacctcatgacccaatcagctctcaaaggtctcacctctcaacactgttgaatggggagttaagtcccaacacaggaactttgggggacatgttcaaacgataacactgcctatctagtccttgtcactggacagaaaaagaagaaattctcacctgtgaattcataaccacttacactatatgtgatgatcaaaagcacacaagtaaaaaattttatttaaggtttttccaagttaatagtataccagataacaggcaaaaagaagcacaaatattccttactcaattttaacctaagcttcaaataatttccagagattgtttcaagaaacgtaagcaatttattatttataattcagttgacatattaaacagcatatgaaatatagctgaaaagagaattgataaactagaaggcaaatataaagaaattatccagaatgaaatccaaagagataagagatattaaaagacacagagattagattgagaagatctaacatatacctaatttaaattccagaaaacaagtctagggaaaatgaaagagaggaaatgttacaaaagataatggactaggaatgtaactgttgaaacatcaaatcttgagacccagggagccatataacatgcttccaaaatccaagcttattatattaatatacaaaaacattaatattaatattatatattaatgttattgttaatataatcattatattattaaacatataatttatacataaacaatatattatatataaatgtatatgatatataatatacaatagttataatatataataaattatatattgacttctatataatatagaattatataacttataaattatatatagctttatatataaatcaataattatatattgatgtgtacaattattattttatattattattaataattatataattggtattatataaatattaattttatattgcaatagttataaagtaaatatcatataacattattaatataataaatatagtatattaatattaataacttgtatttattaacaatatattaataaatgacataatttcacatttctttcagatttctgtaaaagcttatcaggagttatatatatgcaaaaccatatttatcttattaaagaggcatgtataagtgtcagaccatcacttatgaatagatttgacagccagatatacaacctttcagaaaacagaagcaaacctcctccataaaaacaagtaattggcagctgtctcaatgatgtccagtaactagccttatttcactcagaacagttttgtcggcttcatatagcatgaccaatcaccctggtttactagagcctgagggtttcctgcgcaagggactctctgtgctaaaagcaagatagtcctggatcaaccgggatgagttaagtctctatttccatgccttcatagaaatcattaaaagatatctctctgttatgggctgaataatgtcacccaccctgaaattcctatgttgaagtcctaacccccagtacctcagaatgtaactggattttgagatagggtttttaaagaggtatataagttaaaatgaggacagtgggatgggccctaatctaatatgactgatgtccttataagacgaaatgatttggacgtggacacagagggacaaccacatgaggacagggagaagatggccatctgcaagccaaggagagaagccctcaagtaaaccaatgctgccaacacattgctgttgaacttccagtctctagaacgataaaaaatatttctgttgtttaagccacccagtctgagatattttgttttggcagccctaacaaacacattctctaagggtttattctcatttttggtttagtgtatttcagctgatgattatagcctaatcctccccctcttcttggggcctctcttctctgtactcttcctcctcatatctcacacaggcagatttgttcctgcctcctcacctacattacgagctccgcacagtctcctttcttctggctccggctccctcattaatctttctgttattaacgctattaactcgttaaactatctctccacctttccaaacttccattaactctggcactccataagtgttagtcaaataaatgaagaatcacactaactcctctttccttccctctcactccaaactcttggtgagattcttttgcacttatgccctcgtttccccatttcccactcacttgtcagtctcctcattcttggttttcctcattatattgaaacacatctgaaaaagtcatgtaagaccacagccactgcgtatcagtgctatttgagagttaataaagttcccttttcctccaagacagcgagcagagtgaacagaagaaagactggtttctgcccttggctgcacagccatgccccgaggccgggcttaggattttataattcacaaagtcaactgtctcttcccctctccatcctttaggaactgtctgcagtatctgacactgttgagagctctcataccctttaaactctctcttctctggctttctgagctttcctcccacttttgatggcactgcaggagtttttaagcatctctctctcataccaaccccagaaataaagtcattcctcgaattcctgtacttagccccttgtctcctaactctttgaccactaatgttttagaaacactctcctgacaactatcgcatctttgcagttgtttccatttccaacgccatgtctctctgagcagcagccttgagttttcaattgcatatttattagtcatttccatatggacatctcactaaatctgtcatactaaacatgtctaaaatatgtatgtttacatgttacatgtatgtttggtatgtgggaatgcattacattcccacagattttttcccagttacagtgttactattctaatcactcagactagaacactcagagctatctatgagtcttcctctcactcaaactgcatatataatctataaacaggtcctgttgacctcatcttctaaaaatctcttacatgctcctttttatatcattggataatagtttagtgtggtggttaatatcatgcacactggagccaaatctgttaggttcaaatcctgactctccttctatttactaattatgaaaccttaggaaaattattcaacttttcatctgtaaatatggggattataatggtgatccactttatatgactgacaaccaaataagtgaatacgtgtatagcaggtattaaccatatgcttagccgacctatttcaacctcctaaccaaccagaagaactgtagttccctgctctcttgcatctaagtggggccatggaatgtgggcagaagtgttgtgtcacctttactcagaggcaattaaaaagaagacatacttttcctatgttctcattgccaatgaacacactacacagatctcaacctcagaattctctccacactggtatttccaaaatagcttcatgagaagggaaatttgtgtagtttcaatgatttagtgatgctatggtttgggtatttgtctcctctaaacctcatgttgaaatgtgaccccaattttggaggtggggcctaatgggagatgtttcggtcatggaggtggatccctcacaaatagattgatgctattccctgcaaggaggagaggatgagtgagttctcactgcattagttcctatgagagctggttgctaaaaagtttggcatctctcccctctctctcgccatacgatctctctgcacacaccacccgcctttgccttccattgagtggaagcagcctgaggccctcaccagacgcatatgctggtgccatgcttcttgtacagtctgaagactgtgagcctaataaacctcttttcattataagctacctagtcttgtgtattctgccatagcaacacaaatgaactaagacaagtgacaaacacaaaataacttgtcttttagacaatattgatgtctgaaattccacattgaggcatttttttcctcttcgtagcctgataatggcaaataccttctgacaccttaggatggatgaatttgtaagagatattcctggaagcaggtttgtacagtgtagagaaaatgttgggtaacaaagcaggaatggaggagggttaatcagcaagccaaaaagcttttatagttttgcctgctgtgctgcatggaattacatccccccaaaacatatgttcaagtcctaaccacaggtacctgtgaacatgagtttatttggaactaggatctttgcaaatgttatcaagttaagatgaggtaatactggattggggtgggctctaaatccaatgactggtgtcttcataaaagaaaggtgagggagagttgaatatagcgacacaaaggaaacacggggaaggagaccatgtgacaatgtaggcacagaatggagtgttgcagccaagccaagaatggcaaggattgctggagctaccagaagctaggaggaggcaaaggattcttccctagagccttcagagggatcatggccttaatggcaccttgagttcagaattttaggctccaggactgtgacagaataaattcccgttgtaagctgttcagtcggtggtaaatttttacagcagccccaggaaaatatgcctgctcaacaccctaccctgaattttaagttcattttatggaatcattttgagtttggagtttgatttaatccttttcagtaattaacgctcttcattttttactcccaaatatgtcacactggctctactcttataacaattgtatttatctatcttttggtaatggggctgccaccccttgcagaatgaaaagtagagtgtgtatgctcacacctccctccctccctccctctctccctccctctctctttctttctttctcagagtatcgctctgtctcgcccaggctggagtgcagtggcgcaatcttggctcactgcaacctctgcctccagggttcaagcgattctcctgcctcagcctctggagtagctgggattacaggcgcccgccaccacgcccggctaatttttttgtattgttagtagagatggggtttcaccatattggtcaggctggtctcaaactcctgacctcaggggatccacccgccttggcctcccaaagtgctgggattacaggtgtgagccaccgcacccggctcacagaatttcttaaaaagtcattgtgttcagtctttatggatcctctaaattccagctgctcagcctcccggagctaaatgagatcacttaaaggtcgactgttggggcctccaaggtcgcctcggagactcacctcataggcaatcaaatggatcgctgggtttttgtgtgtgtgggttttttttgtttattttttttttccagaaaaacactccaccaagaaggtttttataacctactggaggaggaggatggagagtgggcacgaaaggactaggatgaacatgccataagcaatctaaatgccactgcaatattgcctggtgaggacctgattactgatgttttaaagctaagctttcagttgtcactccacccagtagtgaaacaatgagctctaaaatatatatttcggctcaagctttcttatgtggggaggtaatccacccgaaggtatccccagcctgtacctaatacagtgcccagcactaaagcagctcagatgccagtgaatggtggccactgggaggcctgtcagtgggtgccagtagcggtctcttcagagaaaaagaaaactcccctctgccagatcagtattttatgagctgtgaaccaaaaccattgctaccaccatcactataattctatccacagtaattatcataaaggcctaacaatgccttgtagatgaacattctgagtaactgctctataaccaggagatttaagaccgcaccaaaaaccagtagagggttatactttactgggcacaagtcgtttatgataacgaaattgtagtttaatctgtgaagagatgtgaatgtaactgagacacgcttaaatggaatatacagatgagctttatttttatatctggcatgcttggatccatgccgaccctccagctgctcgggcctgcccttaggggctatggaccgcatgactctatcagcggcactgccaccgccgccgcctccgtgctgcctgcgttccccgaccattgattgggcccggcaggcgcttcctgggggcttccctaccggctccagcccttgggattcgggagcgccctgctaggaagccagagccccgcaggggccgcggcgtccaggccgcctaacgcgcgcccctcgcccggcgccccgaagcggccccgaggggcgggagccgaggcgagcggcaaggccgggccgggggcgcacagcgcccctagaagtgcgggcttcccccacccccggcagcgaccctacctcccgcccccgctgcgtgcgcgcgtgtgtccgtctgtctgtatgctctctcgacgtcagtgggaatttccagccaggaagtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccgggtaagccaaactcgggcgagtgggggcccggcaggggacgcgtggcccaagtcctgccgcccagccctccgcaccccctccagccccactcggacttcctcattcctgcgctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccgaaggggaactcttacaaacttttaaaatccccaaccccagccccacctgggggatggtgagaaggttggagtgcgctgcggcgcggaggagagagggaaggtggttggtgcagtgcagaaccagatttcacctaagggcgttccatgaaatgaaagcagaagtgcttgtcagtcctcttggctgggaaagccctccccagctccccagaattgaataggagagtctattcatccctctcctacttctaaaagaaacctggctcgctctctgtctctctctctctcccccctccccccctccgtgcgcgcgcgcgcgcgcacacacacacacacacacacacacacacacacacgatatagtcacctgctataggacttgattctgatcctccggggcctggcatttgagagagaaaataaattacctacctggatacttagagcactttttagacttgattatgtaaaactcttggacagtgccaccatgcattatgcatgaccgctgaaacaaaaataatgtaaaaacaaggcctatcctaaatgcaagtttttctatggtccttaaaaacagacaccagggaatgtttgccctgacttgctggtttatcctgaaactcaaatgggacttaatgatacaggatttaattatcaagattgacatgttcatggactttgttaagtagaggttttcagcattacagtttatgaaataaccatatttaactcaaagatttttttataaagctcataatctgaaaaaatgcttatggtattactaaaacatttaatagctctggcatcaaaatattctacatactggtgatcttttagtaaatagtaaaggttagggtcaagatattcaataatttttttctagcagaatcccacaactgaatattgtcaagcagtttaaactgcattcgtgtttgttaaaactttaaaagggaaacttaaaactaaagtatgttgtttttctgattttaatattgtgctttctagagatgaatccttttactgtttgaggcactataggaattatgtatttaaatgtatgtatttaaatttgaagcaatgtacttttttgagtttataaacttgggaagacaggaaataaaaagatttgtttcctgtagaattttacattcatgatttaattgaattgctaaaatggaaagaacatgtacgattaatggagacttggaatctgagattattcatccatattgatacacctgcaattcctaaatgccctcccctgcttgtttagataaaatgtcttcctgggctgcagcctactggacaaacttgaacacaaaggaacacacgttatatgtacatttaatactggaaccgaaaagctgcttgcagtgaaaagcaaaccacttctaaactctttgagactttttaaagaaggtagtataatccttttaggggttggtggtgatgtgaaaatctattatctttttgctgaaatttcattcttatgttaggcattggcactcacttgtgctgagtaaatgcccgtgtttttcaaacccagatagtaaatactgggggtatacatacaaaaatagtccttcccctttgtaagcattgctttgatctttgcacttcctttttactctacctcttaaacaagatctgtgttgattgagttgattaaagcacaattaatctgaaataggcagaattttagatttagtgattatattccttacatttctgttgttactgttcctggaaacaaattgaagtagtttgagaaactaatatttatgcaggttgttttaactacacttttagacttgcagataattgattaagtaagttactaccttgactttcagggattgctcattgtggtagatacgaggtctagatagggaattggcagctacatgaatgttggactatcattccatcagcaagaccttatttttacctaatttatgagaggtatttctctgttcagaagaggtgaaagttctggcttctggggggaagtggttacttcataaccttcaattggtttgaacttgggagaagtaagaaaagtagtcgatattttcaaacagtaaaataattgtatctgagttgctgtatggatttttgatgaagtactcaaaatgtcatcttttgcatcttcgggtcttagtagatgtgctattctgagtatagaattgactgcagtaggaagtgtatctggaaatgcacagtactgttgtataaccaatagagtaaattctcagattatgctcttctggtccacagattgatcagaaatcacattaacaggaatggatgtctatgcaaaatttctcattaattttcttacttttagtaggaagtttgttttattcggttggtctgttggttttctgtttacaaggtgaattgtctacagtagtgggattgttatattagaagagaaggagaaggaaaaatagaagttagtgctagaggatatgttaagatgttctgctcctacatctacatttgtgtctaatcagcattaattgatgactacgtcttggtaaacagtagaccatactggagcaatttactctgctttttgggaattagttctcatttgcactcttgcacctcccataaatactgaactcacttgtagtgttcttagaggtcagcaataaaccatcaagagcatatgatctctctttgaattttgtcactactttggagacagacagtttggaagaactgaaggtactcagcctcagggagaaaggtttgaacgttttggcatagtcctgcaagtcagtttggctccttgactgtgaatttttttaatcaaaaaagattaatatttgaaaccacataatttggacagttaatagttctggtaacataaccaagccttttatctttgtagtatttcattaattagtatccagtgcctcacttttagaagaaaaaaagagaaaaaagtagtaacattcttttaatgatgatgaaattgcttcatacctttggtctctgctgtattaggggttgttcctgggtgcaaattaatatactgtcttttacatttccggaggttgttgacctggccttgaagatcagccaacagtttagaaaataagttgtgcaaattgcattgctacacctcaaataatttaaagcctgacagttctgtacagaataagagtcacataagatgtgatttgttaaagattatagaaatctcagaagatagattatggatgaaaatatttgtttaatttagagtactaataataaaaatagtgcattttacattttaaaaagaaaacaatttttattgtgtcatattttctgtagtaacaaacagaattaattatcagtaatacaaatttcatctgctttaatttattgcctgtttttgaaattagaataatgatatatttggtttaattatccattacaaattgccttattatttttcattcatctttcaccattaatccagaaaccttaaaatagcttttattttgacccatgccttcagtagatatcaacagacttgagttcatctatggatcctattagtttaaactgtgacaaattttgactgcttaagctttagaaaagaatttattctttaaaatagccaaaattataaaaaatgaaataaagaaaaagctgtttgagagaatcaaatactctagtttaactaaaaataaataatatctaatcaatactgacgaaagaaatatctgatgcttagcattgtacttgttggtacatagtaagcaatcattaactgttaaatgaatgaatgatatgaagttgttgcaaaatttttttttaaatggacagccatcttctataaggaacaaaaattacattattttgctttgccttctggaaagaaaggagcacaaaatagtccttgtgtcttagatattatggaaatcttatctaaagaccacttgaagtttactagaacaaataatttattaaaaagtatctggcgccttccaaaaggggaacatttcattctgaaagaggcatttatgaactagaaaaaaaatgccttttagtttcaaagttttagaggcaccagagcaagattataaagtaattggaatgataaaaggtgcttgtaaaattgaaaaatgtaattttttggtgaagttagaatttctgtacactccattgaaactgtaatatcaaatactaatacctccaaaaaagaaacaatgctacaagcactgcttggtaatctaagaattgttaacacttatctaaattaatcaaccaaaaagttaaaacaaaatatgttattttgttatgttacctctagaattaaacacctatcacccataaatctgtgactgttaaaagttactagatggcaaacctcaggaacaagcaggcagttagcagggtttactgtactttccactttcatactttaatgatttttccaacactatagaagctggggcctcatcctagcacagtttgttcattatttttcagttgtagcattttttaaaagttggccttgaatttctgaattgaaccatttatttttttgtggacacagttttttaaatgaaatataccatttagactagaaaagagcaaaatgccaatactccctgtcctagtgtcattgtgccccctgggaaccctaatgcagtcctgtgggaaaacaaccattttattgagcgctgctcacttcagttcattctgctttgctgccacttagttctggttctgaccctgatctcccctcacatcactcacaacaaacattcaagtttaaaaattaagttaaaagttagttacatatatatgtaactaatgtgtatattaaatatactgatatatattagttacatatacagatatggcaacaacaaaaaaggttatatatatacatatttgtaactaatatgtatattaaatataatgatatatgtataaatacatatttgtaactaatataattatatttaatatatattagttacaaatatgtatatataatattttttgttgttgccagcaaaatgagaaagaaattaaatgttaacatctataacaattgcactgtaaagccgtcattgttgaaaagtactccgaagattaatagcggcagtgtttgttaaaataataaaataatccaggcactctgcctgtgacttccccatgagatggcttccagaaaaagataaatttttgtgtgttcccttacgagttcagtctgcagcttctgggcatgaagagaagcataaacaaaacaaacaaggctctaactttgttataatccttacgctactagtagaaatgtatggacaattcatgcatttcatattggaaaataaagctattagatttttctttgagatgaaccttttttttgtaatttattttttattttttattttttttcagtagagatgggattttgctctgttggccaggctggtctcaaactcctgacctcaagtgatccacccgcctcagcctcccaaagtgccgggattacaggcgtgagccacctagcttggccaaggtgaacctttttgataaatgaggctcactaatatttctaggatttacttttcactaacttgaactaaagaaagtataagacctgcataaagttgagcatacctctataatgtcccattttaaaaagcaatttgtttttaatgacttttatttgttaaaagcagttatttcaaaaaattatttttattatttatcatgtcatttggactgaaaatactataccatatttcagtgttagggcacacctatccctctttatcccagacgtcaattctaccatataacaagtatgtaaaaaagaaaacataaaagtgatgacagactccctaatcaacctatttattggttctaagcccaagcctgcagttcatttaaatagtgaaaatagattacttaattgtcttagaaaatatgtcttccatgacaagaattttaggaatgagaaaataactatttttggatgttttaacacaaattcccaaatcatgttttattgatatttgaagaacctctttgtctaccagttcttaagtataggcttattttgtaaggcttaaacatgtattggtgtttgactgttaagacttgatctataaccttcagtgtctttttcttttaaatggggtatggacttggtaatgaggccagaggagaataccttacaatttatagcatctgcatataatacaagaaccttcatgatttataaaattaaaatgatgatgatgtggaatgatggaagaagcatgtgtgggtggctatttatgtagaggaaattagaagttgaaagcaatgttaagaattaaaattaaattacacttaattttttgctcagttggatagtcaggaaagtacttaaatcagcaattgatttacgtaaaatcaaaactgaaaactgaatatacaatctaggaaataggaaaaaaatttttagtgtgttcatactgctaatttcaaaccaagcaaaaaacctggggaactacttttcagaggagatggcttaaaatgaaccaaaaatatagccatttctctaccctattcatttaatgcattcatttattatactgctaatacatgataaggtgaataggttaagcatcgtttgtatatgtgtatgtgattttaaacctgagtcttttgaaagattggtcaaagcaaaggataatgaaagcataaagatttagggggaagagtcctctataaaactaagacttaaactttgttatcaacttgaatgtgaagatagaataatctagaaagtgaatgagaattataaataaaaggacaaatcatatatctcatggttgagaaatacaatgagataaattgtatatctcatctcatggagggtcataatgaaagaagtaagagagattgcccttggatagaacctttcggcagacatttcataatggattatcatatttttgctaaactggtaagaatggacttttcaccacattatgaaaaaacactttagaagtcagttgcgatcaagcaaatataagtacctgggaaattaaaatcaaaagcacagcagtccaacaatagtcaaatgcatttactcactctcataccatatcatagcgttaatttgagataatgtctttatggtgtctctttatatatttactcgatttcccatttaagacatttaaccaaatttaaaaagcaatccttagaaactttaaaaatatttcctattttaaaccattacataatcatttaccctgcagttacaattctttttttgtgatgggtggggaagtatcccatttctcttagaaagtcttctgtaatagccaaataggagtcaatccaagttgcttagagaggtagttcaatcctgtgttgaaatagatgacttttggagtaattgtgctatatttactgagtatctgttgaactgtaggagtccagtcattcaaggcaagctacagaaatgattttattgctgaggcacttaagtatcttcacatctatatgccaatattaaatttctcatcatccttgatccccacccctttgcacagattggtatccccagcacattagggaatgcggttgttagcctgttagggtccattcagtagatttctcatgccagaaatctagaagcccttcttatacattcagctttcttcttcagtcagtcaccaagttctatcaaggcagcctcctcatctccagaatccatcccttcctcgttgaatttctagattttatttttgcattgtctcctgcttctaacccatcgttcatttcgcataatggtcagctttctaaagtgtaaatcggatcatgtctctgcagtgaatcccagttgtcttcacaagctgattctcgcacacctcacccccttactccctccggtgttccccaaccatcccctaatctcaaatcctccacaccgactttcagtttcctatccacagtttctgactttgaatgcctttgcttatgccctccctgtatgagaagtgccttttctttcctagccatcctgctaacttctaaacccttaggcctggtttgagcatcaccatttctctcacttgcctttctgttttctccctcccctttccataaagagttatgtgcccccattctgtgttctcctgaattcctgtgggtcctagaaaagaaacatcttgagggcaaggagttcatcttatttactttttatttgcacagcacctggtgtgtttgctgaataagtaaataccgaacaagatatcaagagacagtgctgccaattaactgtgtggctctgagcaagttaattaacttctctgagtcttatttttgttctgtaaaaaaaatgaggtttgacaaaatgagcatctctctctaaaattatgtgtttctttgatgtaattgtattaattggaagacttcagattttcttgccatatcaagataggtcaacttaagaaaaatgcatgtgagtaagtaccaagccaattcttgattatcagtatgataatatgaggaactgcccattttgtcgataataagttataatttttggtctcagtgtaggttctttctcaaatccagatgtttctggtgttgcattttttcattattattcagtctctcgcattcatatttctccaaagaaatttatggaaaacttgagacaaaaattgaatgtaaagtttaatatttaaatgctagattgattcaaggtctcactaattataactatatttggagggagaagaaggggaggtggtggtagtatgagctgaatcctcctctgttccttcctagaaggaacacaacgtcctacatcaagaaaaaagacagaagcatatcttggagatatgaaaagaaccaccaggtaaactaaaaagaaaaagagtgttaaaaagtcagcctttaaaaagcaggattggagatgaggaggggtggagtaggggaagcattgcttgtttatagaagctcttccatcttcgtatagtgtgatttttatttttttattattttttccttccttttttttgacctccagctttagtatagtacagttgacagaaattatatatgtttatggtacacaagatgatgttttgatatacatatgcattgtgaaatgattaaatcaagctgattaacataagtagggttttatttctttaacagtgatttatttgaatatatgttgagtcctttctatgtgccagacacagttctaaggacaaggcacacagtgccaaacaagacagaaatccagaaattcatggagcttaaatcatgtagtcttttcagtttttaaaattttcttgctgggcgtagtggctcatatctgtaatcccagtacttcaggaggccgagaagggaggattgcttaaacccaggaatttgagaccagcatggacaaaatagcgagaccccagtctctacaaaaaatttaaaaattagctgggcatggtggcacatgcctgtggtcccagctcttcaggaggccgaggtaggaggttcacttgagcctgggaggttgaggcttcagtgagcagcgattgtgccactgcagtccagtctaggcaacaaagcaagactgtctcaaaaaaggaaaaaaaaaatagaaagagaaactttatttttacattagccttttttaagttgaagaatcccatagctaaaaaagtacacaaatattaatgctgcaactttagtgatttatctcaaggtgaacacgtttaacctagtgggtggtcaagaaatagaacactggcagcactgcaaaagcatcctatctgccctttcttagttaggaccccttccctccactgtcatttaaaagatttcacaaacaacttttggattatatgtatgtcaattctgtgactcatatatatccacatagacaatggagcgttgactgaatgaattcattattccaaggtgctaataatgagcttcacaccagcgggaactctgctgtgtcagttgggctctaagctcagttcatttcagatattcctcactaaacaaaatactgtttttcctcagttgttagtaaaaaatagaaaacagattacattctcatttacttattacttatgaatgtaaaagtaaatattttgcttaataccaagtagccagggtcactgacagagacatgggagaaagaagtattcacatctgatgttatcagacatagaagagagaggtatagttcacctatttctccccactcagtttatacattgacatctgtatgtgtgttgttttgttttgttttgtttgtttgttttgagatgtggtgtcgctctgtcacacaggctggaatgcagtggcgcaatcatggctcactgcagcctcgacttcctggtcccaagctatcctcccacctcagccacccaagtaggtgggactacaggcatgcaccaccacacctggcaaaattttaattttattttactttttaaaatttttgtagagatggggtctccctatgttgccaaggcttgtccccaaatacctggacctcccaaagtgctgggattataggtgtgagccaccacacccagccatgtatatgttaaagcgtttatctgtatgagtggtcagtgtagaaagggcttcatggagcctgattttgatggcttgcaaattattatatttgtgtatgtgtaatcggaaggccttcgccgtgattatttcttcaaaggaaccctttgtccctccagggtgattgtacccatgttcataggaccaaacattgctggttcacataatgactctttttcttttaaaacataaaggacatatttttatggatttttgaggattaatagaataaaaatctaaagtcatattcagattcaagagaactggatcagtttctctgtatttgaacaaaagaatactaatctctaattcataatgcatgaggtctacttcttcctcagtctgaaaatatgaatattccaaaatggtactcaaggcagaggctatatatcaaaattaaaattctgtgatactatgtttttagggaagaagaaaactgtagcattagaaatgtagacgcaaaaggtcagaacaaagtccagtatgtcaagtccctttataatgccatctgaatgaaagacctcacaccatgaacagaggtattgaagcagtttttatgtggaaatggtaggcagcaatatctcaggagtgactttaattataacatttaaggttttatctaacttattataatccttagagaacttctctagctctacaagttattcttggcagaatttgtcctaacatagtattaataaaaataaattttacttgagtatgatataaattactcttaattacaatataattttaaaatgcccaaaacatcttttgatcttatgaatttcagtcagctatgattaagaagacaaccataggcaaaaatttctttcttatggaacacgttggaatgcattctaatcacttctctaagaaaatccctgtcccccatgattatagtgaatatgatacagcaataatttagatgcttctttcaggggggtgaggttatgtattctacagtctattgattctaagaggcacttttttctcccccaatttaacagttttgtttaattatatacatttcaggattttttggggatatttttctatcactggtttctgatttaattccactgtatttagataacatattccgcatgctttcaattctttgaaatttattgagacttactttatggctcgggacgtggtctatcttcgtgaatattccgtgtgtatttaaaaataatgtggactctgggccgggcgcggtggctcacggctgtaatcctagcactttgggagtccgaggcaggcaaatcatgaggtcaggagatcgagaccatcctggctcacacggtgaaaccccatctctactaaaaaaatacaaaaacttagccaggcgttgtggtgggcgcctgtagtcccagctactcaggaggctgaggcaggagaacagcgtgaacccaggaggcagagcttgcagtgagccgagatggcgccactgcactccagcctgggtgacagagcgagactccatctcaaaaaaaaaaagaaaataataataataataatgtggactctaaaatcattcagtggggtgttgtagacacactaggttcttttgattgacagttttgttcctaagccttctatatctttcctaccatggtttgaatgtgtccccaccaaattcaggtgttgaaacaggatgaccaatgtgatggtaggaaaaggtagagcctgtaagaagtgatgggattaggtgcccttttaaaagggcttgctggaggaaatttgtctcctcttgcctttccgccctctgccagttgcggacacagcattcctcccctctagaggatgcatccctcaccagataccaaatgctggtgccttgatcttgggcttcccgttgccagaactgtgagaaataaacctgggctctttataaattacccagtctcagctattctgttatagcagcattgacagactaagacatttcctgacactctgttgatttgctttgatcaattaccgagagaggaatgttaaaaatcttaactgtaattgtggatttgtcattttttccattagttctgccacgtttttgcttcatgtattttgaagctttgttaataggtgcgtacacaataagatcattgtttttctttgatgagttggccctttgattcttatatgcaatgttcctctttgtccctggtaatgtttattctcttgaagtctactttatctgatattttagaatgtagcctgcttttcttatatttagcatttgcatgatataactagcccagtgtaccatcttcatacatttaaactgtgtctttaatattaaagtacaattcttatgaaaagcgtatactttaatcttgttttttaaaaatccagtctgatcatctctgtcttctagatgagttcagtccagttccatgtaatattattattattattatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccatgtaatattattactggtatgttgggtttaagtctctcatcttggtaattaattatctatttgtgctatctcttctttattcttttttttctcctttcctgccatcctttgaataaatcaagtttagtgttttaaattccattttatctccttcattggttactttctaaagtggttactttaccactttagaaaagtatttgtttattacaatatgcatctttgagtctctaattaatgtgagaacttgacaatgttatacttctgtttgtccttctgtgctgttattgttatacattttacttctttatatgttataaactccaaaatatattgtcttgttttgctgtgaacagtcaatcgtctgtttaggaaattaagaaagaagaaataaaagtcttctgcttactcacatatttatcattattgatgctttttattctttcatacaggtccaagtgtctatcatttcccttcagcatgaagaacttctttttagcatgtcttttagcaggtctgctggtgatgaatactcttagctcttgtttacttgaaaatgtcaatttcacctttatttttaaaagatttatttgctgaatattctggaccaatctttttttttcttttatcactgtaaaggtgcctttacattgccttctagcttgtactgtatctaatgatcatcagaaacatcatgcttatcatgcttatcaattgttcccccatatataatatgtcctttcttgtcctttgctattttgggattttttttttctctagcattagtttttaacagtttggctgtaatatgcctaaccatggttttatttgtctttatccagcagagagatctttgagattcttggatctgtgggttgattttttaaaaatcaaatttataaaaattctcaactgttatttttttgaatattttttctgtcttttttctgtttctgggattctatgttacaaatacgtaagactgcttaatattgtcctgtaggtcactgaagctgtgttcacttctttctacctttttttctctgtaattcagtttgggtagtttttattgacctttcttctagtttattggtactttcttctataatgttaaatatgctaagtccatctagtgaaatttcatttcagttctaaaatttccattcttttttttaaaagaaaggtatgcatttctttgctgatattgcctatctgttctctcattatgttcatcttttcctttacattattgaccatatgctattagctatttttgtcatttgtgtcattttttttctcagtcttattttcctatttctttgcaggcttcattatgttttattgtacattgtggagagtttgggttttttgtcttcctttaaaacgtgttgagctttgttgtaacaggcagtgaatttactggtggatcacctagttttattaagataggtttagagtagcccttattttaggatgtttctaactcccatcgtgtggtctttctgaaatcacaactgaatgctcacaatgttcagtgatgtctttccaccctggattattacaaattcagtgtctctcagcactatatgatgtctggaatttccatttagctcttagatgcccagaaactgttttctattaggttttgcagggtcttgtcctacactatcacagcttggtatttggccagtgaccagagatgacccctatgtagatttctgaggctcttgctttttgtgtaaagcctttctttgtgatattctgcccattggtgttctctctttgggctctccctgtgtcatgatttggaaagtgtcctcagtcaaaaagtgagggcgaatttagaatttacctaaatcaccttataatatatagccctatgaagtccaatgtcttaaattacatctttaggtattttgtatggtttcacagttgagtatagcaaggagggaggttcagataactgttaatctgtgataactaaaaccagaatttgacattctgacaaacttgaaattgcagtgcttcttaaaattaatacagtattacttaaaaaacaaaaacaaaaaaaccagtgttttccaatttgccaatacaaaaaagcaaaactcccatctctactttttaggaacttctatccatttgagaagatgataaatatataggtaaagttagattgcagtaaaactatgctgtctagtgttaaatcaccagtatatataagttttatagatattatgtgactacagagctataggttataggaaaaatataggatttcttggcagaaattggatttaactagagccttgaagagtggatgctattgaggtagaaaagatggcatttcaggatgcagggcatattgtgaacaaatgtacaagatggaaatgagcaagtcattctgaatgattaatctgtctatcatagagggttttgattaggacatagtagtagttgatgcttataatatgatttaatataataatgtaatgtgctgagtggttgaagtctttggactttatcttataagtaatatggcaataatgtgaaagattcttgaagaggaagaaaccctgcagtgagggagaacagtacagagcctattactgtcattcagaggtgaagcaataaaggtctctcctaggatgttggaaagaaggggcagatccaagaaacaacatgaagaaaataatcagcagaaattggttattgactagatatgtgtgaaaatgatatattggcagaaattgcaaagtcaaaaatggggctcattgcagcaggaatgatgaaattgcttttagatagagaggtgaagggatttaaaacattaacttgttttaaaggtatcactgcttaaagctaacagtgatttattaatatttgcactctgaaagttttaacagttttaattttatgtatacaccacagtgttttggctactatacttgcctcttttgttcagttgggaattgagtaaactaatagagtaaaaaaatgagtacaaagtgggctttgactagaactctaacaaagtgtgatcactgaattaccaagataattaacccataccccacatatactccatttcccatgacacatattatattgcattgtttttgcctatttgccttcctacttcctaaactgttgaattagtttgcttttgttgcattaaaaaaaaggagaatcaccacaaagcaaattaaaagatactgattacttcttccaattctgtgggctgcctagttcatctggcctggcctgctttggctaatctctgaggtcttttggctacttgactggtactgtttgtagctactcagctggtgccctactgctgtttgtctgaagttgttttggctactcagctggtgctagggagcctcagctaggactgcctgtctgtgctccacatggtctttgattttccagtggctggtgcaggcttgtttgcatggtaacaatgttccaagaaagcaagaatgatcattgcaaggcctcttataagctgggtttagaacttgtacttctacctcttcctattggtcagagtatgtccgtaggtctgccaagactcaaagcacagagaaatagatgtttcctcttgttgagtggcatataaaaaaaagtgtggccattgatttcaatctgccacaaccgtaagctctgtgagtacaggaactgcatcactcttttgcactttggtgttgttggcatagtaggcataaatatttttaggtgaatgactaaattaatgaaggaaggaaaacattcaggtagtatttcaatatactgtagttttaaattatatatattatatacatttgacatagtttaatatataagtatatacacatatagttttcatatataagtatattatatattatataaaatatttatatgttatatataaagtatatatataaaatatatagttttaatatgtaagtatatgtatataattatatataatattataagtatatatacttttatcataccatcagtgagtatagacatggttcagggagaatctctttattctccttctatcttttgagatagaccaaagaaaatttttttttaaaaaaagaactatcacttgagttaacattgtttggtatttttatcttcataggtgattgccttgtgaataactcattttgtgtattgtcagaatcctattctgcttttcaggctgtgctatgggtagactagctctaaccagaacacttgggagacctgaagcaaagatactatattaaaataagtaatgttatatgccaaagaggaaaaccacttctgcctcctaaacaactgaaagaaccagagactgtggggtcagattagctagcattactatatgaacctgagcaaatgacttactctctttcagcttcagtgtcttatctaggacattggttctcaggattggtgtgagaattaagagaaatatgtgaagttctagctacagttctttacccatgaggtagtcagtaaagtttacttctttctccatgtgaaccaaagcactgtcatgatgtgatgatgttcattagggtttctcatgctcagcgttattgatatttagggttgcataatgctttattgtgaggggccattctgtgcagtataggatgtgtagcagcatctgtagcctctatacactagatgccagtaggaccacctatccagctgtgacaggcaaaaatgtcttcaaacgttgccaaatgacccctgggggcaaaatgcaaacagtttatctagcagtgacacatagccagccaccttagaaagggaattgtcagcgtacccataagtgtagaatgggaaacaaaatacttgagtcttctcagaatgtctaaaccttttgctgtctatattcctctttttataatttaccacaaacatatattgcttattatgccatctaataaaatggctaacatttgctgtgtattatactcggtgttaataagctttgtatgaactcactagctgaatgttgtatatgtatctgccatacctgttggattgacattccactgtaaacaggtaccttatctttaccagctccaagcacaatgtatttggtatatcaggtagctattctacatgttaattgatcacattgcacccaaatgaaacatggatgtggaagtggaaggaggagctttaaaacatggaaaattagtttatacaaatctaaatgttgtagtgcaccaaattgattcctttttaaaaactttcagaaatcagcttttaaaaaaaaaaagtaactaagccatgatcaacttttctttcatcaccactaagccaatatcagaaagttgtcaatcaacagctcttttaaagttgaaatttttctattgtatttcttatgaagatttcagtagtgcttagaagtttttggctcatttatcatgttttattcactgtatgtcattaattgttaaagatgtcagagtcaaaccttaaattcaggagagatttaaatttttcctttttcctatttaaatatatgtttctaattacataattcagttagaaaattacaatatagaaacatataacttagtaaaagtttccagttactgtatacagattatattgtatactgtattatttttaacagttgcatatttaacttataaatgtggataattataattaaacaatctgttatcaaaggacatacagattatttccagttccttgctgcagtgaatatccttgtacttatttttttacacacttgctcagataatttttaagtacaaattcctgaggtagaattgcagaatcaaaagatactctcatttgagtgtttcacattttatgcaaagtattttgtttcctccagaaaattcctctgtggaagaggcttcctcacattctttatcagtttattagccagcagagaaatgatgaaaagccaccccttttcttgtagtttcatcctcattgctatccaagatgaggtattaaaatcacacctaagtggtgtctgttgtggctgaatataatcttgaaagtagagacacttctctctgattcccaactgtactctctggatggcacctaaaattttattttttcaaactgaaaatcattttaatgagttcgaaaaggttttattttttaaaatgaaatcctatagaaagaatacattttcttacagtgggtcatggtcaaaagtgtgaatatctctgatcctagaaagtttccccagttacaaggacaggcgtgcccccaactccatccttaatggctcaattctgtggctttcaagttaatccactcagtcctacagccttcaccaagaagctcatgtgctacactttggtgttagtgggggcattgtcacacaggttcagaaaataacccattaggcattttatagaactcatcacatgttcagaactaagctagttgtaacattatgtttttcatgtgaaaaaacacaagcaattcactggctattttatttgttgctagctagctatactttctatttctttttccatggtgtgaaaatcttcctagaaacctcactactgggaaaagagatgcagagattagtcccatcttctcccctggaaatttactatcgcccttttggcttcaaggtccttcctcaaaagcaaagaattgaacaagggaaagtgaggggaagggctgggggaacagggaggtagaaggggttttccctggtcttttctaatcctttagttccagacgcttagttggtatttcaacattttagaaataaaacctgcttttataattaatgcaaatattacttagtgattcatcctttccaaatgattcttggtttcttttgacatttcatttttaaattgtgaattaacattgacatcaccatagcgttactgttacctcagctctttacagtgaactgtattgcaaaggctataaaagttcaaattttaactatcacccacgtgagccttggactgctgttaggcttttgaaactgtgatcctttggcaagaattggtgtataaatcatggggaggatattgaaggggaagatcatgtttaatttggcagttgggtgcctgcaattgacagattttcattaaggttttagctatagtagtgatcatgcatcagttctaataaagtaggtttcgtttgaattttaaaaattagagtgaggactgctttatgttaactgtttacattcagaagtctggaaaaccatccacaggtttaaatgtatataatcagtataattaacacgtcaacagcctcacctctgtttttgaggaccataggctaatattatttatgaaggttcaggagatcagtctagatcgacagaaagcttaagggcaaagatggttttaatatttttcttggaagtttgagcttctgtggtattctaaggatagggattttgacattgattgttctagctggtattcagtactgtatttaagtgtaatgtttttactagtattcttcttataactgaaaactatgctaatgattctttactatagatatatactcataaatacgtgtaaaaatccaagtttaccaaaaaatattaagacttaggggatatgttctttgaataggcatttatttgctaattaacatattctaatctcaacaaggttatattcttttcaaaaatccattccatcaaaatctgtcatttttacagatgaagaaacaaaggccacagtgagtttagttaatatccaagatcacacagccagcatgatagaactcttaaatttcaagcgacttaccctctttactctatcaggtcaaatttcccttttttaactgcttgtcttaattgagatttgtttaattgtggctgtctgtatatcttcaatcaatactttcttgttttagacaaatgtttccctgcaaatctgcatgaacttcatgttctgaaggactcagagctgccctttcctttttgttaaagttgtacactgctctgcatccccctagaatgctcatcagctttctcactcttcctcactcacacagtgctccagcaggagaggatttctttgaaaatcagattcttttttggagggctttgtgcttattggagtgttatgtgatatattcattacggtgagggctaaactctttgaacaaagagacctgacagtgcatttgggttaaagaacaaagtttatttctttctctcatcaccaccagcatgagcagcctggatggtcagagcagatctgtctcatggcattgttcagggatcctcattccttccctctcatttatctgccatcccctaggctattaatcatcatgtttttggtagaagccaggtcttctccatgtctgagtttttatggaggaagcatgtcaagggccttaagcccagacctggaagtggtatgcaagagttctgacattgcactggtgagcatttggtcagatggccatctctaactccaacgaagtgtagggtatacactaggtaagcagtcacatttccagctacaatactaattctatggaaaaggagacaacatattttgatgggtagctgacattctcatctgcagtcctaagtactcatgactgctagatagactttatgaaaaaaaaaaagaaaaataaccccaggaattaatatttaccctcagccttgtgtttctttaattttctcatttttcatgtcacatatctaaaatttgatctaaataaatttaaataaaattaacctttatttgaataataataaggacatttctcaaggaagtaaatctcaaatgatatgtgattttagatactatctttatctgaccatgtggttccttgcttctatcagggagggcctctgggtaatagaagattgctagggcctgcagtatattaatgtttagctggagttgattaaatctgagacctatagccttgataataaggacttttatttttgtatttttattgcacttttaatattacagagtttctgtaccagcttgacaacagcagaaacatggcttgcttctgtggaacacgctagagcagcagtccccaacctttttggcatcagggaccagtttcgtggaagacagcgtttccacagactgggggctgggggtgattttgtgatgattcaagcacattacatatattgtgcactttatttctattattattaacattgtaatatgtaattaaataattatacaactcaccataatgtagaatcagtaggagacctgagctgcttttcccacaactagacagtcccatctgggagtgacgggagacagtgacccatctggagacagtgacagtgatcatcaggcgttagattctcataaggagcgggcaatctagatcccttgcatgcacagttcacaatagggtttatgctcctatgagaatctaatgccactgctgatctgacaggacacggagctcaggcagtaatgcaagcgatggggagcagctgtatatacagatgaagcttggctggcttgcctactgctcacctctttttgtgctgcgttatccatagcccagggtttggggacgcctgcactagaggacagagcctggtacactatagcagtcctccccttgtgttatgcagagtactgatcagtcccttttgagcttctcaaccttgtataaaactttgagacagttctgggaccatcacaaggtttatgaagggttagaaaacaatacacttaaggaactaagactgtaaatcgttgaagttcagagggcgataaaaagaaatggcttctaagaatcccagtatgtatgattttttatacaaagcataaagatgatttgtaccaaactcaggacactgtggcgagcttaacacgagggtattgaatcatacgtaagtggtaattcctagattatgcaatctccttgctgttagatttagataccaaagaggaactacatcatgtcctcctcctatggtcttcaaaaaaggattatatttggtcttactggtataatacagtttattcctgcatgaattccatggtgatagaatttttaaagttcattctagtgttacagttttgttttgttttgttttaatacacagcttcagaatggcagaagatgatccatatttgggaaggcctgaacaagtaagtgtcataatctcactgataactttatttaaatatattcatatttcaaaaatatgcaaaggcaacattagtaagttagcattaggaaaattctaaaattagtaaatttttttttaatttcagtttctctgtcctttcatgtgaagttggagaggatatgtcatgtgaaatgagtaacttacacccgctttcacacatattgttgcacaaaaattgtatatgctacaggatagctattgtattagctttctagagctaccataacagatcaccacaaacctgatggcttaaaacaacaaaatacattatttcacagttctgggggctagaagtatgaaatcaaggtgttggcagggttggttccttctggaggctctcaggaagaatctgttccatgcctctcccctagcttctggttggttgctgggaatccttggcttgtagctttatcgctccaatctcttcctccattgtcacgtgcgcttcttcccggcgtgtctctactgtgtctctaaacctaaatctcctctttttttcttccaaaggcatcattggatttagggtacacccttatccaatatgacttcatcttaatttgtttatatctgcgaagaccctatttccaaataaagtcacattcacaggtaccggggattaggagttaaaggtgtctttttgggagggaacacagtttaacccactacagccccttgacatatttatttaatgtgtacacatggatgtagagagtggaatgacagaccatggagattcagaaaggtgagggatgggagggcagtgggatgggggtggatgataagaagttacttaatgggtacaatgtatgttatttgagtgttggataccctaaaaaccctgttttgactactatacaatctatgcatgtaacaaaattgcacttgtaccccatcaatttataccaaaaaaaaattttatttaaaactcatctagtaaggagacagattgttgtagtgaaaagatctttgaactcagaatttgaagatctttatataagtactgactactacagatcagctcctcagacttgaagaatcacttagtccccgtaatcctcacttttctcatttgtaaaatagaaatgctagcaccacactaacagggatgagtcaaaaatattcaatgaatgtgctttgtaagcataaaactgttcctatcattatattagtagttatgaaaggatagcagtgtccttttttctttttctcctatattttattttgaaaaatgttggaaaaaataaatagaaatgttggaataatctaacaaatctacattggttcttaaaaccgacattttcgcttttctctttgctctctttttcgtgtgtgtgtgtgtgtgtatatatgtatatatgtatatgtatatacataatcatttggaagcaattttcagactctggagcaattataatggcaatattaaattatttatgtaatgattccaagaagtatttaaaacatggagatttgttcattcatcagctatttattgaggtattactacgtgccagaacattggcttagtggggaaaaaataagtgatatatacactctaatttcaggaacctactattttaataggaagaacagagacattgttttcatatggtgatatatgctgtagtagtagtctgcgcagagcgggatagaaatgttaataagcagcatcactaggtgctaccttggaggaagagcagagttacggaggactttccgaaggaagtcttcgtaagctgtgttttgaaagatgtagtttgctagactagaaaaggtgaaggaacactaggtgccaggatagcctggtcacatttaaattttagtggcaatcatttaaaatagtggatttctgaaattacacgtgcaaagaatcagccagaaaaataaaaacagaagtggaatatgttttaaaggctctggtatcatttctataaataaaatggacatatatagcatttatcacttcgggtgatattctgattgatttagaaagaatgactgcattgcttttcacattaagatgctcctttctaattttatttttaaaatggtgatttaggataaatctaggaacattttcttttattgcagcaaagacatttggctaattgtattatcaaaaccgtttgttttacctttcgcttttaatgtgctttctctaacaattaagggcgaactaaccagcatgaggattgtgtctgcttgattttaaaccatcctttcctgtctgtacacaggaaatcttatcaacaagagatgattctttatgccacagaagagtaaaacctgctgaaaacattcattttgaaagtttttcttatgtgggcatctttgcgatcatcagtaacaggggtggggcatattctgacatttccatttttgaggcaagcggtcttgaagtttttttctttcttggcttgagcttggtggtttatatttcctaaagtttgcatgtcctcagtgttttagtggagtctggaatttgctctccaccctgacctaataaacaatgcaagctgcagcacaacacaacttctctcttagtctgaagtgaagagtatatctctctcctaaggtgagcccttttgcccactcgccagtcatttagccaccacaggaaagagttttcctgctaggttatcacgtttgctctgagactgttaaaatcctgtatgaaatgaggcccatttttgcagaacatggtttttcattcctgtatttccttttcagcaaacaatgaatagcatcagtgagcttttaatcttataagcattgaagtgaagcgcattctttgttcctcagttgaaaatttgcatccctcaaatggatctgaagtactgtttatttaaacgagatttttcttactcttaatttaactaggcatacgaagatcttcagtaccccagaactttcaataatttactactaagggcaggagacaaactgtaatactggctactaaaagaaacgaaaagctagttcagcacacttactagtctctcataaaaagtaaaatatggctggtttccatgctgtccacagacatttcaaacatataacttctttaggctaaaataaatagcaagctcagaaatacagttttaaagtcctaaatgagccagcggttacaatgttttttgataagtaatgaatagtaatttattaagataaaatgtactttcttcaaaatattctgcatgcccactctgttgctgccctaacacattaccacatacttggggcttaaaacaacacaaatttatacttctgagtcaggagctcagaaatctagaatcaaggtgttggcagggctgctttccttcttgcggctctcatctctttgccttttgagcttctagtggctgcctgctttccctgtgcaccctctcatcactccagcctcttgcttccattgtcatacttcctactattcagtgtgatttcctgaacccctctcatcaggcccacctggacaattcaagacactctcttcatcttattatcattaccttaatgacatacgtaaatttccttttgtcatataaggtagcactcacagtttctgaggattaggatgcagacatgtttagggggtcgttattcagcttaacacacccactaaattccaggtattttgtgttatgctaggaaactgaaggtaaaagaaatgagtgagctcagtgcttagttgtctactccttgtactgtcagttatattttcagttattctgtaaatagtcccagaggtgctctctagcattctttcaggccttgacattggatagctagatgaggggtatatttaccaccatagaggaaatactgatttctaggattatattattttgtttatacttctaagagagtacaagcttcaaatcattcattcaacaactatttaagtatctgttctgtgataagcatgtacttggccctgaagatataccagtaagcaagctagaccaggtccctgcctctggggactttatagccaagttatgcttctcaaatccctttgttacgtaaacgttgtccaaccctatgtaaagttttgtacacatgagaactacctaggtctcatgaagatcttttaaaaccctgatttaaaatattttcagatttttgtttttggctttagtttcattcctattattacattttaggtgtcccaacttcaaatttttcatataatataggaaaaataatgattgaaacatttaaatgttcttctttacagatgtttcatttggatccttctttgactcatacaatatttaatccagaagtatttcaaccacagatggcactgccaacaggtaagaaaactcatccctgttaccctgttgttctgctttcagtcttagtaaaatgcaggatttgttaatagtctgtcctagaaactcagttgtgtacctagaaaggaaatggtgatttgttttaaaaaccaatcttttaacatactttcttgaaatatatttgcacaaaaatatttcatctcaattaccccttgtatggtttactgcatttcatatctgctaggactactcagaaggaatttctttagtcaacataaggattttctttattatctctgtattccttttaagtcctttctcccagattcacacgaggcagtctccactcttcatttctgtttcaaacatttaagagggcctgttgtgtactaccagtgtgccagtcactggggaatcaaagtgtacagaaatcataaaaatcatctcattagaaaaatcatctttataaaagcttataactttgcactctgacaagttggataaaactcataatccttccttctaccatgactgtattaattgtgccgattggcaactgtttaatttcgtaagagtaataaaaaaaaaactctctttcttaaaaaaagtgatttatttgtatgtaagcttggtgtgatggctctttttatgttctgtttctctcctcacttcacccgtcaccagtgggacttaacagatgttcaaaagcagtgtgagtgaattatggaagttatgtgtaaaacagagtttggtaatcgctgaaggaggcatcagctcttttatttaccagggacttgcttgtcttcattgggggactttatcccatttgtattattctcatttaaaattatcatggttactacagtacttacttttcttttgttttagatcagaaaactttttctgcatttatatctttagtatttctaggagttcatgggagggaaaaaagtagatctactatactttcaccttcactagtaaaggtgtatttcagaggtttttctgtctttacccctacaaaacattatttttaggctgccatgtctgagatcttgtgaagtgctgtccaatttgagctctaggtcagcttcctgtgaacaagtaaatgtgttggtagtgtgtgtgtttcttgggaactttttaattctggagttcaaagtatttttcttagtattaatgtattactgaaaatataagaacttggttctgtccacaggaaatacacacattttcacttaatgtcttgtgaatacaaaacagtatcctgaggcagacgttttcttaattttattccttcggatttatgggcatgaaaataagattatcaagataaccatctcagtaaatattctgtggtcacagctttatgttgtagaaattattttgccataatattagaaaaactattcaaattacacctaaaaatctaatttgttagttgttgttacaccatcatttttacctgtatgtttttccctcttcattgcagtgtcatagtacaatttttatagtccaagatatataggatgttgtattcaaatttttaaagaggtagagaggttgattatctaaaccaatattaacttgtaactctaaaatggattattttagtcttctagattttttgaaatctaaaacctttagtagatctagtacttgttgaagactatgggatgcgacataactcttaggtctaaagttaaatttctctgcacagtggaatgtccttttcatggcacagaaatgtggccaaaagaatgttggccttaaaacaacaaatacatgcatatcaaatctaattttctagttgatttaactttaatgtgttgcctgaaagaggaaaaatggctctattttacatgaattttcacatatttaaaggaaattaaatcctacaggaaaaataatagcaaatttgcagttgtttttagcagagttaataaaaagtgagagacttgaagtttaatgtaaacatgcttccaactcctctgtatttttcatgacatccaaatattgctctgttagaggactgtcttgatatgttctttcaccattttaacagggaatgtttttataagtgttacattgtcatacaggctgtatcttagtgtgaaaatatttctatttctaatcaattttatttccatatccaaaattaaattctagccatttggtgggggaatttttaaattatgattatgtttctaaaagtaatttaaaatgtccaggggtgaatttcatacagacaaaagatggtaatttaatacattgaccagtgactcccccttttttttcttgtgtatgcttcatttcagatgcattcatttttcaactcgcttccttgtaaatttcttgaataataacaggaagtaattatacccttgttttctccagttctctagccttatcctgatttatcataatattgaaaagataaaaataaattctctggccgggtgaggtggctcacgcctgtaatcccagcactttgggaggccaaggcaggtagatcacgagctcaggagttcaagaccagcctggccaagatggtgaaaccccgtctctactaaaaaaatacaaaaattagctgggcatggtggtaggcgcctgtaattccagctcctctggaggctgaggcagagaattgcttgaacccaggaagcagagattgtggtgagccgagattgtgccatggcactccagcctgggtgacagagtgagactctgtctcaaaaaaaaataaaaaaaattttgagaaaattctcttttgtgttatagtttatttttaatttcaacctgaaggtttatctccttacaaatttatttaaaataagaggtcttgagcttctttctgagagaaaatgaagattaaaatggacatacaagcattctcctaaaatatttttagcaccaaacatcttaatttgcattcaaataaatgagaaccaccatatgcctttatttattgcaaagctatggattattgtactattgacataaaaatcagctgggaagcttaaggactttttcatattgaacagtttgtacttatgttgtcagagattctgattttcctttgaattttcaagtcagataccattagggtatggattaagcctctagttttctttgcgtttttacaataactaatttgcatgtacctatcttcaattaaattattttcagtattttataaaatgcctgagatgttttagaacacagtttatatgatagcacaatattcaaaattgcttataaacatcaaaagttatggattaatatgaaaattttaccatgtctgatagaccagattacattgggagtgtcggggaggaaaggggaaacaaactaaccagttaaggaatgaaggcagtactttcccttcaagtaaagacgggaacagaaaacctagtgtaaggaaaaagagatagcctgagatcattatctgtctatcagacgtatacatacaggttgctagatcagtatcttttaatttcacattaagcacactctctttgaggaaggaaagtcagtgtctaatgatgtgaaggccaaagaaaatgtcatagtgcccagaagtggttgctgcttttaattggtatttgtcattttaaaatgctttgttaggagacaagattatgaaggctgttgacatcaattcttgccggccatatgccttttattgggttaggaaatgtgccatcacctttcaacaaacatttacttattgtggttcgctaaactcgtaaaactattgttaaaataagggttaatttaatatttcagacaaggaagagaaattatatccttgtggaattttaaccaaaaattgatttgaaatttctacataaaaacataatttcagttttttacttgctttacgttttataccaaatttgagaagcctcacagtttcttttggtttctgtttgttgtttttgtttttagcagatggcccataccttcaaatattagagcaacctaaacaggtaagattaaaggggtgggactttaaatgttagattccagtgtctaatattgagatcataagcactgaagaatagtaaatgagttctatgaaggaagtagtttatctgaaagatcaacaacctgacaaattatgtaacagctttattcattcactttacatttctcttactcattgttcacactgtcctgagcctcagtatgtagttctgtaaaactgcagttaattacagtattagaattacagttaattacagtattctgctgtctctaccagcttaacttaccagccactcccaggaaaggcagaggtgatttccattcattttcatttataaggaaatacgtatgcatacagttcacatgcactgagcgatatccatctattatccttgcacatgtagtacctcttagccttcctccttcctttggtagccccagccttttctgtgctgcctttggaacatgtaacctaacatactgaaagtaccagtgggaagtaaaatgttagaatgaactattgaattctcttccctctggtgtcagcctctttggagtcaggagaggaacattttttcaggtgcttccccttaccactagagtctgtagagaatagctcagaactgaaatggcctcctcactgtatccaactctgtggatatttataggaaattggatgggaccaatgctgtgaaagagaaagaaaggcaatctttaatgtctgcctataggaggtttcagttattagggaatggaaataatggtgtagttccccacagaatgaggacagtcagtaaatctttggatggataaactaatcacatttgtgtgtgactgaggatatggatacctgtcctcttgcagctgtattacccaatacattttctaagtattcttttcattagctcaggtgagtgaaacacttttgcattttgtaacatttaacacatgctaactaggtcacaagcttaaataaagcatccactgcgttgtggtttccagaatcgtgacattatatatgtgttatatttggtcagcatttgatataaatgtcttaatgattgctgaacaggctatccttataaggttgaaattagatgaaagtttttgctgtgggggcaagaatgccacatgaaactttggggcatggttctagttcttgcaggtgtcacatcctgactcctcaggttgccagtaacactccattgctctacctccatgttcaactcttttaagcagttatttctcagagaaggtcatcaattcccagtgaaattttatcccttaaagttctgtgggctctggcatcctggaaaatttcccagcttttaagatctaggtagtctatgaaacagaaatcaactgaaatttgtctgcatatgccaaagtattttttccaatatcattttcataagcatagcactacaataagaatttttaaatgtaattccttattatggatccaacagttataaggaaaaattggcatttatgatttacctgaagggttaatgtagttccaaaattcaaaatttaattcatataaaagcttatgtgagtaaaacaatgtgtttaccaaagtgatgctattttgatatctgaattcagtgaaagtaagaaggttgtattcaagtcagactttctgactgaatggatgtagccttgcctttgaggttgatgactcattttaagcaaatggagttactgagatgagtgaatgtggattaaaggcaaaattttgatctcagaaatttagaatcagaaatgcatccagacaatgcatttgacgacatcttcctgaaaacagttgtaaattttcatcctcagattaaaaacttctgaggatttagatactcgtatgtaaccatgaaaaatatctattaagtattgtctatttgacaccactcccaataagatataaacacatacgtgtctatatttttccaactgtcccaaaggaattttgtgattaaagataatgaattgtgtgtgtgtggttttggggttttttttgttttttttttttaagttagaaaaagattcttttttctttgggacctcttagccacagattttccccagctctgacggagatgagtcatagcatagactactaatttttagaacatccagttctgttgcatattaatcagtgttaattaactaatactgttcaaaaactcaagttgtgtttaaattagcagtcaagtaaatctctattcttatggttagctaattctgcaggctattatacatgtgttgtttttttcatggttttagaaatttcatttaattatttaaaaaaccaacagtgtttgcttacaaaaggcatagggctgaaattgtaaattatttttaaatatgaattgtgtgagaaccaaaacaaaggaattacctctgaaacttcatctccaaaggcttcccttgtgtttagatctggaatctcccaaggaattgttttaggtctcactgtgatgagttgatcataaactttagacatttgtgtgcattaaggaaatttcccagaccggggaatttactttatgccttacttatctggtaaatgtgtttgaggactgatctttggaaatcaggaagtttttggataatataggaacagttccagatgcttcccagagatttaaatcagttcaaggcacctggactgctcagagactgcaagaccctacttggcataatgaaatgtagtatagtctaagtagtgcatacgttttacatttgttcatgagctcaaagctgtcaaaatctgcatgtttgctggggttccacaatttaatgagtaagggagtgaacccccaccagcagctagtgggtgtgatgagctgatgggcagatgatctagtgctgtatatgcagagttggtcccacaatagaaacaaaaggtgagaatgttccttaaaaaatcttaacgtattttcttttcaccaaaaagtgaatctgtaaaaagaaaatcatctgcttaagcgactatgtggttataaactactaacactaccacaaattgattgacatcattataaagttgaatcaggaaatacagcgaaacctcccttaatatgatgatgaggtcataattatccttgttttattctttgtatacaaatatgaataagttagctttataaatcataaaaagttagaactggagtagaccttaaagatggtctggtataatcttcccttttgtacaaatgaaaaaatatgacacttcttaggtgtttatcagcccacagtagtttatatagtgaaggcttccagctaacttcattaattaactatatctataaaatttctgggttagatagtatttaagggaactacctagttttggaatcattctggtaggttaatattcaatcttgagcttgaccatattaataatcataaaaacaaaaatcttatcctctgaaatgctgagagaagcttaacagatgcagggtctagcacagggtgtgttctacaacgctgaaacagtatatctaaataaacatgtctgtagtccctgctgaaccagctgtaatcagagtagataaaggaatgtctttaagtaagagtcaaggaagcataacttttattaatatggtacagttcagagcttggcagcagcaatttaagacaaggaagctctgactagaacaagccgtaacatgttaagtctaaagcctaaactcttcagcagattactctccacacatgcatagcatgagaggttccatgggcttaggtacctggctttttagccatatcttagtgtacaaatatcgattaataccatttttcgtagtaagattacgggaaaagtgattcttgtttacagagccctctttcagtttcatgtttttcttctctcatttagtagacataagatttaaaaatttgtatgtacctttgttgccgtaatttttaataagtatttctcaaacttaattggcttaacgttcacctttgcagagaggatttcgtttccgttatgtatgtgaaggcccatcccatggtggactacctggtgcctctagtgaaaagaacaagaagtcttaccctcaggtcaaagtaagtttgtggtagctctccttctatttgaattctggaaattttgatttcctacgatttccaaggaattgctttaaatgagtacgggttgccttcgctcctaagctgaagtgttcacatgattattaaaatttttaaatagaaatttgtctcctagcaatagaagtgacagatactaaaactttgttaacatttcaatttagtagaaatgtcttcagcattagctaacaaacttactatttcttgatcatcttaaatatttttaaaaattggatacttcctgaaactttagtaagtctttgaaagaaatggttgattttgactctttggagatttagtgaaaaaccaaacaagtgactgagtgtatggattatatagtatattatttaagattatgaatttggatccagactttgttattagctgtgtagctttgaataggtttaaccaatacttctaaacttcagtctcttaatgtataaaatacaaaaatattaatagtatatacttcataaggtcctttagagattaaatgagaaaatgtgtacatgttccatagagagcctgaaagtaccctagggccttggcctgagcagatgtgtggccctcttggaatgaactgctacgtgacatgctggtggtgtatttggtcataccttttaccatgttcaggctgtttgtttatttgagaatatttttctttaagttaatatgagacttttaatttcataatatgctatgtttcatagactgactgatgataaacatagactgataatcattttgcagataaacgcagtcaacaattgtaatttagttttttataaaagttattatttagtcagtaattcaaggcttggacaaaatagttctcactatgtgtgtgtgcccctcagggtgtaacatacttttggactcagtctttttattggtttgtttttgtaagtagatgaagctcagtagagcaggccctcagcaaagttgtgatgtaaagaaatctggccgggctcgttgactcatgtctgtaatcccagcactttgggaggccgaggctagcagatcacaaggtcaggagttcgagaccagcctggccaatatggtgaaaccccatctctactaaaaatacaaaaattagctgggtgtggtggtgtacacctgtagtcccagctagtcaggaggctgaggcacaagaatcgcttgaacctgggaagcggaggttgcagtgagccgagactgtgccactggactccatcctggacaacagagcgagactctgtctcaaaaaaaaaaaaaaaaaaaaaagaaagaaatcagtctttggttttgccagccttgcattttgtttcttccttttcctcttatccatcttctaggcccaggcctgttaaatttcttatccttattcccaaacaaaagacaaaatgttgtgacgtcgttctttacctttcaagtgaaactcacccattatttagtatgggtactactagtcatagttgcattttaagtctcttagctccaattgtggaatgaaagatgttttttctattaaaggtaattaggcgggtaaatatgatggcttaagtccacagaagcagaccacggtcttatggcctcacatcctttagaaccttgatgaggaatgaggagcagcaataaagaactaatttgcacttattaaacaccaaagacttgccaagtggtttgtataacattatctcttttaatctcttagaaatctcagtaggtaaaaagtgcaatgcctgtgaacccaaacagactcagagaatggaattataataactggcctttctcacaagactagtggctctatatcctgcagcaggctattgctcaccgaacctctcagatataatgtgtgcatttggggtactgggggcagggagataagggacaaattatgggcagacaatggtgtaaaaaggcatggtgaatgataactcttgaaaacaagggagagagaggctcactggtcaatgggtactcaggtattggggaagccaggcccagcacttacctttttaacacatgtgtctgtgtgtcacatgtataaatattgtgcctttatgtatgtgtatatttgtgagaaggggattgaaagacacatgttatcagcattgacactgactataatgactgaagaattaactttaagcgaaaaactgggagttttttctgactggcttggcacaaaaaatataaattatggtattttgtttacttctattgctctagtattttgtgactaagtaacaattcttgatactaacaaacacatggcattaactttcttataaatttattggctaagaaaaaactttatacatccatttattcccagtcttcatacatctttctcatgtagaggtttcatctactcaaaaacatattgctgcctcagtcacaaaataatttacaaatgaaacaacttagtgggcattagatgttcttgtagaatgaaagtttctatatcaaggagtttagtacttactgggaaatatagatatgtaaacgactaataataaagcaggttcaactacagtcacattatttcaccaaatcatttattttttattcactaattcagtatccatttattaagcatttaatcaacttgtaagaggaggaggaacttagaggttagagaatatgactatacaagctgtcattgttcccttagcttgtcattgttcactgaaaattgaaatggttctgctgttcctaacagttataggaagtaattttatttatccaagaaattcttaattggaaggatgggtaggagagaaagaaagagacaacggccaggtattttttttttccagagctcttctccaaatatcccttttaatagttatttctgctcaggatgacctttaagtttacaaaggaattttaaatccccttttcctctaatgtttaagcagaggaaaaaattgttctccatgcatctttctaatcaggaagacctttaaaattgtgcatgtcttttctgtggtactttactaagcacctgctcggcgagagactgtaagggaaacagtgggatagatacatctaaagtttctcaaacttggcattattgacatttggggcttgaaaattctgtgttgtgggaggctgtctgacacgttataaaatatttagcagcctccctgaccttgactcactagatgctaataggattcctataattgtgacatccaaaaagtctccacattgacaaatgtcccctggggggcaaaatcacccctctttgagaaccactgatgtggatgcaacaaagaatcaaccttaaccttacccatttgcatacttttctactataaagttgtctcgcatagattacgtagaatttccaagtgtattattttataaacgtgcctttcttggttattagtagatatttcttattttcaagatggtgatcatggtgtctgtataatttctgttagaatatcagagttagtgtacctggatactaaggagaaagatagaaaagataaaatatgtatcttcaacattttgtattctgtgatgaccctaaaagctaatgtgggagttctattgactgttataaactattacagaagaaaaagtgaaagtggagagttaggtccactgtgtgtgaacaatgggagggtctatggaatgatgctttcaggtgggcagaggcctcgtggagggtggccccacactcacccccagaatccagaagccattcccacaggaacttcagagggagagcatttacatttacaggaaagaaatgatacttctgagcctacatttgccacatattcattaagtgcatttgttcaggcattacagtaaaatgccatgggctgtgcttttcctcagctacagcctctctccctccaacctcacaccctgtcttcctgtcatgcctttgtgagagcgccaccactctgcggtgcctggagaggaacctggaaacgctgatagttcagtgcatactcggtcatatggagacagcaggaaagagtcaggggccaacttgaaagatttggggcctggctgtggtttgcaggctgtagacaccaaactatactttatagaacatgtgaaaatatagcctgtatgggttactctcttactgattgtctagatttgatgccttacattaaatcattttaaaaccaactctagaagtctactcaaatcctgcattttctagtggaatagtgtcccatgcataaaaccctgtttcgcataggtgtaggctagcttacagaccctcttaccatgttgagattatttctagaactcaggctactgaaccatctggtgctctgcctgtgtctttcacatagctaagaagaaaatttccatttagctttctgatatcttgctgtgcaagtcttcatgctctttttttaaaaaaaattttaattataaattctttcaagcatatagaaagtttaaaaattgacataacagacactatgtactacaacacaaatttaataggtattagcatcttaccttatttgcttttgatagctctctctctctctctctgtcctctctctctctcaaataaaatagttacagctaaaaccccacttatccatcactttgtcctccttccttctcttaggtaagctgctactctgaactttcactccccaagatgtttttatatttttactacataagaatgcatctataaatactggcattttcaagaaagttaatttttactaacttcaacccaaatttgccattgtataggatggctccttttcagggcaaacataggttcaaactggacgccattgaagattaactggtactcactttgatcctattgattcctctttgctgtctagataaaaatgtatttgtcacaatgtagtttgtactaactcttatagcaaaaaataatattcagagaaaaatctaggggaagtaagtatgcagactaactcttatatcttgtcctttcataagaaaaatttcccatcattaaacatttaataatctattatactgcctataaaatttccctttaaagttttttccattctaatttcatcacggagctcctaataggagaggctggcagaaaagcacaggaaccttcctctaggccaagcttgtccctgcctgcttttgactcagcaaggagtgccagggaaggctcacttccctatttttcccgaaagccacgcgtgaagttttaaaaatcaaactgtgttccctttcacagaggtgggtgacaagagaagcagccccatgggacttcagaaactctcaccaatcctcctctagagtgaccagaaagtaccccttcctatcctaactaatgtgacacgtccttctgtgtggtccactctatgcaaaaccagaaattgacaagaatgactttgattgtaaagtacaaatagcttaccagttagtattcttagtttctctttagttataaatatcaaatgcaagggacttgaaacccagctgatagaagtgtaactatttttaatcaaacattttctgaaagctggttctcacatatgttgtctttcctgagtgttttatgttgagtggaagacgtgttgaaatgtttaggtcaacaacagcttttttgttgtccccttccactactgatttaaaaaaaaaaaaaaaaggctccactcttcgtgcctttccttaaaaatcctaaatgttaagtttctgtcgaggtcgaatagagactacccgatctgctgtggcatttgaggatatcacatatccttgcataatctccctttcctttgtatagacttgtctgattcacgtggtttggatctatttggagtactaatttaaaataatttaacctgactcaattacttaaaacaacaggggagaaaatcaccaataatcagctatgtgtgcgtatagaacctagttcatatcatttattaggatttccattgaacccctaagctgttcactgcgcaagtatttaattagggaaaataaccatacccctatgtacattatactgtgtgttttgtaaaccatgagaaaagctgcttattgaacagaagggctttgtaacctggggtctatggatccctgttggtggtttcagacgctttttagattcctaaatttatatgcagacttacacatgtatgtatgtgcattttttcttgggagatgagtataactttttatcatattttcaaagggaaagatttaacatggttaagaatcatgctatagcttgtatcactttagctttttgatagcagctatctttttaaatgatctatgtaatattttttaagattttttctttttttattcttgcatttttaatcaattttaaatgaagtgaaatgctttatgttgctcaacacatagcccagaaagcctcccttcagttttccagtaggtggaaaaaagatgaaactgaattgatggccaaaagagttgaatgggcttcactgctttttctttcttgctcttccatacatttgcagattaagcatgaagctcaccattagtgattgaagccaaaagagagaaggcaattcattgaacaaatattgattgagcactgtgtgtcaggtactgctctagacaagcagacaaaactccctcccatatgtaaccacaattgagacttataggtaatttttgttgcaagtagttcagaagttttgtattttgtcctaaaacaaaatattactttgtaaaatatttttttaaatagccctctaaatccgctgtatatattcaaagtcactattataaagtggagaaagctactcattagagaaaacctatcacacagataatagctgggaagcttaacccttagaaattattaggagagatatacactccttgaatttaagaactgtctgaattttaaattttgttttgtcagttctggcttggtgaccttcctctattggccattcccatttttctgccctccactcttccttgacacatgattatttctgggaccactgttcaatccgaaacaaatctctggtggcttcttttaaacccagtggtctcagtctgaaggtatagtggggcaactctcggcattccattctggagtcttgacctcataaagtcacatattggcaattcgccttgataaggtcaagtgaacacacagaagcactaagatccccacatgtgttccactgcctcctccacagacaagttgtttttcaacccatctgcaggtccagaggtgaagctggaggctaccctgcagtctcagtcttttctccccaccctccagatggattccaaataagaagcctccagactaccttcacctccctggggtctcatggacatgggctggaaagtgcttgcagactttcacagacaatgctttttgcctttaggtccccttctacccaacagaatgattataataatggcttgatgtgcttacttacatcatctcatttaatcatcacagtaatccactgatgcaggttctgtgatccgcattttataaatgaggaaattgaagcctagagaaattaagaagcttaacttgggtctcacaggcttttagagatggagcccaagatttcagttcatgccatatggtttaagggcctgcactcttaaccatcgtggaataccattcattatcataatgttaaggatctgtttctactttgcaggaatcttttaaatctatggttcacaatcatgggtgggcttcagaatcgtccaaaaatgtttcaaccacagagacgcctgggaaccactgcacaattgctaaatcacagtgcatcatctagccaatcttggattctacaataattctatgacagtttctaagaatacatgccattatataatggcaacatattacaacagataattgaatagatattcaatgtataccgtggaatagaatattatgccactgtgttttaaaaagataattaagaggatacggcacaacgtggaaaactgcttataacataatattaaggataaacctcagctgggcatagtggctcacgcctataatcccaacacttttgggaggccaaggcaggaggattgcttgagcccaggattttgaggccagcatgggcaacatagtgagaccctgtctctataaaaaaaattttttaaagaaaaaaaacaggatttcaaattattgctaatatttgtagtgattacaaatattagcttctttttataaagcctgggtggaagcatatagatgtatctttagctttatttattcatccatgacttaaagaagattggttaacacctgactccaccttgagtagcagaacattggactgaaggaaaaaaaaaaatgtgaagctgtcttacttagctacagtttccagcatgttttctcaggagctctatgggagacagtgcagtgtggctctcaaaccttactacccataaaaatctgcttcaaaacctacttaaaatatcgattttattccatttccaaagcctggtagagtaggtaattctcccactacaatacacttagtaacactagaaaaaaaatataacattttctttaatgcatagctgagtttattagaaagtatgaaaactactggggcgccgtaagacaaaagaaaactttgggaaaacacaataggatatgggtggactttggggccacagctgccctggaaatatttgctgacctagataatcaagaagcttggtttttaacagcttcctagagacaaaagataaggccttgggcctttccaatctgaggaattgaaactgcaatcacccacttaattcaggactctctcagggctatagtttctgttgatgggtgatcctcaggcagagaggtgatgaggaagttgcctgtctcagcctagggggaatcagaagataaaatgcctctcttgagaatcaataactacaagcccaattcttacagattcagagttaagtgtatgctccctgaatagagtaggaaaccccaagtctagaaatgaatatgaagttgttccacattggggataccctcagagccttgcagaaaagcataaaaatgtatgtggctcaaagaatcatgagctcctgatcaaaaattagaaaatatgtatgcaaataagccactctgtttaagaactggcagaacaatgaaaagcagaattaaatcctcagaatcttcagataattgaattaccaattgtttgatatataaatacaaaataagtttggaatagaaaacagaccaggcagaatgaaaataaaaccaagtcgaatttttaaaattaaatgtgcgacactgaaaatgattcaacatagttaacatggataatttgaaagaaaggatgagctggcaggtacaaaagaaggagtaagaggtgtctagttgaagtcctagaaagaagtattacaactgcagatttctggctctacatttacagtttctaggtctggggtgaggtttaggtggttgtggaccacacttttaggttttaaagcattggctctgaagtcatttggttcagggctgggcatgatgttggttcctagttttgcgacttgcagtgttacttaacttggctaagcatcagcttccttatctatgaaactgaaaaaataatacctatgtcataggatatatgtgtaaatcaagttattcagtacatgccacacagtaagcacttaaaaatgacagttgcttctatttttatataaccaaatacactactacaaatattgagtggcagctttgctggttcatttatggattcatggagctacacaaaaccttcaccagtctattaatttatttttagtacagtctctctaatcagtattgcttccactgtatattgaccccatatcctttcttctgtctggggttaagataggagactgagatcagctgtgtcaaaagctttcttttagatgtaacacatgatttcttatgaaaatctcataggtaggataccagaaaggaatttattaaattcttgttaggctccttagttgtattagttttgtagggcagtgttttaatttaggatacttatgatagagagcaccccttccataatcaggagaaacacaagatggaaataaagattttattacttagtggtcctggggagcacacagcactccagggaaggccacacaccaagatcagggagcatgtggagaaagagagagaaaggaactcacgggccattgcctttactgggtccaggacattatccaaacaggtttcccacagggagttttaataggtgggtttcaagcaagcaggtatgagttccaggaggtcacagtgtgatgaagaagaagtcactgtggcatatctgcacagtccatgcgaggtgtgagcatcagtgaagaccagtcaggtaggctatatgtagctggcccatggggaggcgatcaccaggtggcaattgtataatgcagatatctagattggccacatagaggaaccgggaggaggtgtagtactggaaactgcgtcgacggtcactgagccctgctttaggtatgagaaagtccagcttatattcagaatggatgcaaaggcagcataaaattaaaagcattcactgccagctgccataacaagttaccacaaactaggtggtttaaagcaaccgaaatttattctttcacagttctggatgctagaagtccaatatcatggtcttcgcagggccgtgccccctttgaaggctctaggcaataatccttccttgcctgtttctagcttcttgtggttgctgacaattcatggcagtttgtgacttgcagctgcatcattccaatttctgtctccatcttcacatgaatactgtcttctctctgtgtccctgtgtccaaatctccctcttctttctcttagagacctgtcattgtgtttacggcatccataaccctatgtgacctcatcttaactaatcataattgcaacgaccccatttccagataatacaatattctgaggctctgggtagatgtgaattctgggggtacaccattcagcccactacaaacatattgtggcattgaggttataagccagtagccctacaagtataggatgatgcccatttcagcctgataatacactccgaaagagatcacatggtaacattgttgcctcagttaatcatagaaatactcaattagtatagaaataacaagaaaaatgctttgttattctcatgtgtcatttatcgagttcttactatgtatctgttattgttatccttatacacttctgcacaaaagatggttttatcccaagttttagcttagaaactgaggcttaatgagtaacttgaccaagaatggcttctctttctccatttccttcctctcatggtgttgttttatatacataaaataatatatattattctattaatatagattaatatatgtatttatatatgtacattttatatatgtataaaacttatgttgtaagttttatatacatataatatatattctgtttatatattgaatttatatatatataaaacttaacactattaagtcttaacactattaagtttcatggtgttgagttatatagttctattaattatatatatatggggggaggggtgtttctccagcctagacttccactttgaaatgtagtctccaggctcagccacttgtttgacattgccacttggatgtctggtagacttaacatattcacaactgaatttcaaatcttccccaccaatctgctctgcctcatagcttcccctttccggaatgtggttgctccatccttccagttgtacaggccccaaatcttggagttttccttgactcctctcttcttctcaaatcccacatgtaatccatcaggtagtcttattggctgtgccttcacacttttttcagaaactaattattcttcagcacctccaatgctgccaccctggtataagctaccatcctcagcatctttcttccagtggattttagcatccatgaatgattatttcctaaatcaattatcaataattgttataaatttgtgatttttctatttctatccttcctgtcacttttcctggtttttttaaaagagctttcttcattcttctttaaaaaaaattaaaattaacatcagtatgaactcgtggattcttttgttattcattgtactataagccattcctgtcattattcattttgattcttaaattgtcctattcttggccagtgggagtctttcatgctagctcctatgtctttttgatatgtccctatcttttttttcctaacactttccttatttctgaaattataagctattctaggttcaccctataccttcactaccccagtccaggcatcgtctgtctctctaagaagtcctagttccttttagcaggagaagtttttctagactctttcattaggcagagctacaaaattgattattttaaaaatctcgagttcatacactaattcataattctaattccaatccaacactgcaggcttcttccctccctcccctcatcccatacttgtatttggatttgagatatgaaatgtgtatctcatatcccatatttcttcagtaactgaaaaccctcatcatcaatgatagcagcatgcttactcattttgctcagtccaataattcacacacatttgtagaaaaatagaatagttttagaatggctataccaatatctgcaagcttactatattcggttcaaaatttctttgtagttcttttgaccaaatgtattcaacagagagcattcagtcagagtaatgtgtacaaaagttacttggattaaattttttccttctgtgtatttatgtttccattgagctatagagttaagctatttttttatttctattccattttaggggttttcccatccctgttgatttagtaattttattttttgaatatcaacatttgtcagtttcacatctttcatttatatgagattaactagaccctttagaaatcattataaagtcaggttgttctattaatttttaaaataggtgtataaaaaccaaagggatcaatcagagccttgatttaaagtacgttctgaattatttcagacacccgaatccatctaaacccagaacatttcatttgtagatttcaaagacttcttggccttcctaccttccttacatttatgtagcatgtgtttatccaaggcacaccacctgccaggcacagtgctgggctctgtgttgacacacatgaatgtgatcatctttctgtagcccccaggttacatggcaccacagccaagatacagacatgtgtgagagagtaatcagggtattactcaggatttgctggaggaatccctcttcaaaggatattctaaattggtgtgtgtgtgtgtgtgtgcgcgcgcgcgcgcgcgcatgtgtgtgtgtgtgtgtgttgaggtggactgggagaaaatataccctccttgagatcacctcctggctagatagtctctcccttctctgtttgtgatagaatgcaagtggaatttgacaggtgtacttctcaaactagaaactagagagctgctatctcagtcaccgtaagaagaacgaatcacaccaaacctacatcattgtcttctatgacaggatttctacaagggtgagatagtgagatgctggagatccctgttttggtagttcagggattcacagcatctcccatgctggtgatgtcaacctgaagagatatttctagtgataggttccagggatctttcaccgaacactttaatatattttatcattgtcctgaatacagccctataaggttcttactaaatttgcaggtgacatgaagtgatagacaacaaacaatttgaattcaaattaattttgaaagctgagacaatggacccaattcttcagcaattatatttaaaagatataaatacatgcagaaaacaaattacaagtacagagtggaagagagatgatttagcagcaacgcatgcaaagagatctaggagttttagttaataacagactcaacatgaaccagcaatgcaatgtgactacgaaacaagtaattcctcattaggctgcattaatggaaacacgatacataagaccaaggaagtggtggtctcatttgcactctgtgatgaaaggccacaccaggaatacagtgtagtactgctgggcaccacatttgtagagaaatagaaaccaacttgagtgtcttcagagcagaatggtgagagaactcaaacttcattcaaatgaggagtagttactgagcctgagaaatttatagcctggaggatttggttgtcttcaaatatatgaatggctgtgatggggaaaaaaggattaaatgtgtcctgttgtcacaagaggatgaaataaggagcggtgaatggaagccccaggcgatagaggtttcagttgctgctgacagtcagggctgtctgaggatggaatgtattgcctcaggacaaagtgagttcattgtcactgaattggttcaaaaatgaccaggaagactacagggcagggaagctaacttgtattacaataagtaatttttttcttttttatttgtatgcccttagaaagatgtttacttaacttgataaatctgtaacaagggataatcaagatttggttataggacaattacaattttctgacagatcccccaaaataatagaaattaatagcttacacactactttatccaagctgtagaatgtataacttacttcatatactttgtgtttagtcagtttatacaggctgaacaacataaagttaagacataaaagggttttttttgcaggtttaaagtactaccatttttccaaattactggctgatcctagaactttgagaaactttggtgtttccccccttcctacttttgtttacatcatagtacgtagatggtacaatattttggttaacctcagtctgacacttagattgtgttctcttttgccctattaatgtctagagtgtaaaaagaccagtaaagtagcaccaagaaatcaaagaaaatttcccagttctactcacttgtaattctcttaatttagtaggggctttccacaggaaatcacaatagaatagttgaaatgctctttatcttatgtactttccttctgaagaaagggacagttaattggctttgttcccaacatggtccaaatttttatacagggcagctgtatttactgtagtacaaaggagattctacaccgaatgatgtctctaagtattttcaataattaagaacctaattgcttctctagccagtgggtttcagtgaaagtgataaaatagattttctaagcaagaaaaatacataatgagggtggttgtatacctttaagaaaaaagaaatcagtgatattcaatcccaagtaaatttggatatcacagagtcagagatattcttaattattttaaattaaatttgagtcaaaaacaatgtgtttaaagactttaaaatcattttaaaagaatgttagaaatttacattaataatttctattttcaatgaataaatgagaaacctagaatttttgttttggacacactttgatcatatctaatgtgttctacttcctctaattatttttatgttattaggatttttaaaaaacctcttagattaaaatttctcagtgtatctttgtttgcgtgtctttttttctctctccacttatgtaattgaagcatttctgacatatcctcagaacacacagattcttatcaggacttaactacccagggcagggccctccttggatttactgaaaataaacactttgggtactcagtctcagttttaatgacaaaagttgaaatctttgcctaacatgaaggtttttctttgtctctaaattttgattttccatgctatcagaggtcccattgcaacaggtaatttgagtgttgattgtatgttttctcagtttgtaattgtggtgaaatgtatttaaaatgttcacaattttaaagttaagtttacctataaggttctttccaactcagaaattctgtgatggtaaactttttttttgtagtttgaaaatgtgatctttggatgttgtcttctgtgtcctatgcatatgactaggaatcatagaattttagagctggaaaatgagtgagacattatctagtgattctgcaaatgaagaattaaaaggcccaaagaggttaggtgactcacgcagtatcatagcagtacctggtgactagaactctggccacctactgcagcactaaaaattaacccaaatgtttttatctgaaaatttgcagacttcaggctaggcctgtaaataaataaataagaagttaaaacatatttgagaaaggtaagcttaatatgccacatttgggaaaagatgtgcctgacacaaatgtatttggtgtaatagagaacattcttccattataccgaaatgaaaattttgaacattctcaaaattcttgaattttgagacatttatgttaagcacagtttattcagactctctataaactgtgctgtcatccctgttgttttctccaagcggaatcatacttaaattacaactttagggagtttaatgtttcctatttttgcactcctgggatatttttcagtgactcagaagcataaactgacactgtgaagttaaggctgtgttccagtgggaatgacagcatgtctctaggacgctgatggagaaagccctcctcatgcagctgtcttgcggagtctccctgctggtggtgaatgtgagatcacacagggccagcagccagggcagtacatctctgagtctcgcttctggttttacctagagccaacccttggtgattgtttgcctccttggccaagcccccacacaataggaaaactgtgtctcaaggtcgaattctattaatacctgagaggtgaatttataaacatttaagatgttttagcatctctgcagccagtgtctctgtaaatgaaaattgcttctcgaagtagaaaagcataagggagtacaagggcttcaaaaaaaaatccttttaggaataagaatattgccagggttaggtgttcctaactggtttcaagcagaggagttagtaaaattccaaaagttaatcagcttcatgtactcaacttttgctaggactttgcagaaactcctcagggatccctcagagttagattagggagatgaaccctgccaaaggacagtaaccattcaacagctggatagcctgttgggccccactgtcctcagcctttcctaatgttgcctgggaacaccacttttctgctccctcctttttcagtgtagcctggagacaattatttatttattcactagctcttttaacaaatattgattaagtaggtactggttctgttctaggggttggaaaaacagagaaaattaaatagtgcctttgtcctcaggaaacaatccatttaatagagagacgaagatatgcccttaaatacctgaatcaccagcataaccagcacctgcggctgccatgtgggaattgttgaacaagataatttttgaatgaaagagtaaatgacctaattgctctaatgtaaagataaatttctaagagtcggctagttgggatgattatagaaggattcaagggagagatgtatgaaagcatagatctaacgagagaaaacagcacagcagaaaaagcagcaaaggctcaaaagtagaaatctctgagatcgaatggagaatagtaaataatttgctggaatgaagagcacgtggaaggcaagggtggtaagaaggctggagatagtagataaggccaaatcatgcaaggatttaaactgtatgtttttagaaaatgggtaagctatagaaattttatataggaatgagaaattatcagcagcattgtgctttaggactacaaatctggtagcaatctgctaactgatattggaagggaaaggcccagagacactagttggaagaattgcagtgattcttcatgagctaaactaagagttcaagctaagatagataaactaaggaatgagaatggaagaaagggacaaactgagatttttggggtggtactcagctgaagtttggcaactggttaaacataaaagacaagagacagagaggaatccaagatgaaaagacgattttgctgcacttttttagaaggcagcatttgtatttccatttccaggaggtggagtagctttgagaagaaaggtgattagttcagttttgggcacattgagctgtaacggtattatggacaggaagataccctacaaacagctggaaattttgcacatgcttaaaaagaagatgagaacatgagatttcaatttagccatcatctgcatggagtagacaattcaatccaggagacttgataagaatgtcaagggagtgatcacgataaaggtgagaaatggactgagcatcgatctctgctgaaacatctctttgagcaggaagaagagtgccttagcaaaagcagccagtgaaatggggagttgggggagactttcaaggagggaatggtaacatatcccattcccaaagaggtcaagtagggttgaggaataataaatggctagtgggtttggaaacatggaatctgtcatgacctttacacactttttcatttgatggatcgggggattacttacatttgcaaagggcctcagattaagtggtaatggttcagcattagtaattagagattttcttatgtactttgtagggagaaatagaatggcattcaaacaggtttaagttcctcttaagaacctttctcattggattgtagagaagagcaaatgaaagaatcgttcagtatttcttggtatcatgcccagcccataggtttcaattaatgttaacctttacagttgtcatcatcattatccagaaggggcttttttttagaataaggaagaaaagcagtgctcatctgtagacaagggaaaaaatcctttggaagagagaaagagaagggtaattcaagaagatcaggaataaacattaagggtaaaaacagaatggttagccctggaaaagggaacaaacatgtttctctgaattaggagaggatatgtgaagtaacagggatgttttgagcctcagtaacagtaaggagaagagagagtgaaggaacttgcacgcagtgacttctaccttctcattaaagtcaagagagaatctcaactgcagatatctgcttaaggtaggaagagagaaataagaattgctgtcatttattttgtggttttgatatagcaaaaactgtactagacactttacctcctttaatcctcagaaaacttagagattatatatttgtattcacattctacaaatgagaaagcaagtaaaaaagttaagtaactctcccagagtcccccagatggtcatgggagcccagattcagagccagctatgtcttactccaaagcctgtgctctttattgaaacatactccactagtttgagatcttggaggtgtacccctgcactactatcaggactacccctgataaagtcctgtggggtagttgttcctatccatcaccacagtgaatatcaaagaagggccctctcatttgaggaataacagacagtgaaattgagatggaccagaaatgcaaatcctggatccctgagggaaacaacaaaatgaagcatagaggaaatatctgagtctggtgccaagactcatcagtacaagagagaatgcctaatgggcaatagcagttagggtgggaaaagagaagtacaagggggtgtcttggaatttgagggaagaactgctgccttagttttcgaaggatgattattcgagagttgccctcccttcactttctcacagctggcagaattcctacctcttagtggttagattcctttttaccagatactgtagggccagtgcagcaaccagagcccccagccagaaaccctgcctccaatttagaccagtgttctgctctggtgtgtaataatcatattctaatttaaatagcctattgagatgctacattgatatctagccttttttttttttttttttacttttaagttttatgtgcaggatgtgcaggtttgttacataggtagacgtgtcatgggggtttgttgtactgattatttcatcactcaggtattaagcctaatatctgttagttctttttcctggtcctgtctgtcctcccaccctccaccctttgataggccccagtgtgtgttgtttccctctatgtggcaatgtgttctcatcatttagctcccacttataagtgagaatatgcagtatctgtaataatgggttttctgttctcgtgttagtttgctaaggataatgacctccagctccatccatgtccctgcaaaggacatgatcttgttctttttcatttctgcatagtattcaattggccattttttaaaagacaaaataacaaaaaaaagagtacagttatctccactcctcacccactacctgccacctaacccaaccctttatattttagtaattgccttccataaataacattttatcctgtcttaattatgcattcattagtgtattaattattgaatgcccacaatatgacaagcattatttcaagcactgaggatacagcagagaataaatcaatatcctcactgtttttattccatttttttaagagacagggtctcaccctgttgcccaggctggagtgcagtggtgcgatcatagcccaatgccaccttgaacttctgggctcaaaggacactcctacctcagtctcccaagtagccggaactacaggtgcacactaccacacccagcttccccactctgagcctccatcctaatggagaagagaggcagtaatcaaaatacatgaaatgtgtagttattagatggttattaatgtatagagaaaaattaagcagagaaaggagcaagggattagggggtcaaagttttggtaggggtagagtggtcagtgaaggccaccttgagagatggcaattatgtaaagcctgaaagcaggtaagaaatatacaggtatacagatgtccctggaaagagtgttctaggcagaagaaatagaaagtgcaaaagctaagattgctcacctggcaagttcaagaacagtgagaaactgatgtggctgcataggagtaagaagaaaaaggacggagaggacatgagatggtcagatagcctagggccttgtaagccattataacgattttgtcttttaatatagagaaatattaaaggtttttgttttaactttttaacatagaaaaatgtaatcgtatacaaacacagaatagtataatgagcccccttgcactaatcactcagctttaacagctttcactttgggaggattttgagtgaaggagtgataagacatggcatggcatgacatggcttgaacaggatcactcaggaaaataagccatggggagacaggacaagcagaggaaacacaggagcaaaagcttaggagacagatgatggtggctggaaaccaagggagtagcagtgaaggtggtgagaagtgatcagatagaggatatttttttgaagatttgaattaatattatatatattatactttaaagaagaatttgaaaatgcatgtagtgtagtaaagatggtaagaaatacagaaaagaggccaggcacagtggctcatgccagtaatcctagcactttaggaggcttaggtgggaagctcccttgaggccatgagttcaaggccagcccgggcaacatagtgagactctgtctatatggaaaaaaaaattaaccaggtgtggtggcatgcacctgtagtcctagctacctaggaggctgaggcaggaagattgcctgagccaggaggttgagtcttcagtgagccatgatcataccactgtactccagcctgaatggcagagcaagaccctgtccctttaaaaaaaaaaaaaaagaaagaaagaaaaagaaatataagaaatggcactagaatatcagtattatatacattattttctgtttaaaaatccacacaactggcaaaaaaaagtgacatacatgaacatttataagacagtgcatttataaattacaaactctctgctcctcccatattattttgcagtgatgaatgattaggccatccaaacgtaaagatttatttgtaatttgctaatgatggaatgacaccttttgaggtacaagttcccagcaattcttggaattagcaatagtgtgttacttctttctcgaaagaagcatgatttgtaagcagctatatctgatgtagtaaaactgaaagttaaaataaaaaaggaaaccgtgggtcaaagtatgagggaaaagataaaactttcagagcaaagttatacatagagattttattcatcgtctctgtgtaactcacgagaacttcttagcttatttattatgtcaaatggcagtttgctcttctaatcccagcctgatatcatgagccatatatgctgttggtcattcaaaaagggcactaaacaaggtgaaagaatgtcagtgaatcaatgcaactccatgagtactaccaggaaaagaaaaacaaaaaaacatgccattaatagtgggtcaaagaggatttttttcatgccatcccctaccttactgagaataccacatttatattcagaagactcataatgaattccagagtcctctgtgtcttggctgtatgactttgggttatgtcactttgttaatctgtttgaacttctgttttcttatctacaaaataggggtaatagagtcaactctgcctccctcacagggactttcggaggcccaagggtctttacaaataatagagaaggaaagaaactggcactttaatagtacctaccatgtaccagggactgcgtagtccccacggcagccctctgaagtcatgtgattggcccattgtgtagatgtagagcttaagactcagagaggttatttaatctgtgtaaggccacagagctaggagggggaaaagctgggattggatcactgactagatcaacttgaaatctcctgcctgacagagaaagaagagactaactttactaagcatctttttatgccagaaactgtgttggacataattctgtactatcttatttggtaaaggtcattctgtccttcctggttgccctggttgctcaacaagtaataaacaataaagcctgactgtttttcatccctgagagaagaaatattattaaaatagcgttattctctttctttctttccttttttttttttttgtgtgtgtgtgtgtgtgcgcctgataatctgacttgcaacctcacagaaaagaatgaatgcatggtttcatgtctgtggcatgactctgtgaaggagccttgcaaggggacagatacacctctaccacttcttatagccattcctgagacctctcttctcacaacacataccagcaaagccaaacaaacaaggtgtttaggaataactgtcatctatcaacactctctaggcaaagtagaactatgaaacactgaggagactgcacacacacagaagaaaaaatgatcatgtcacatggtagcacagagcaatgggaaatgtgaatagtttgttgaggtggacagacccaagctcaaggattgcctgatcgctccatttataggaaccatggcaacctaccttatcttactgagcctcagttcctccagctgtgaaatggggtacaacctctgaccccacagggctgttgtggggattatctgagttagcatgttccataaaacacagtaagttagaaagtatagctgtataggctctgggagtttaacaagcaagagaaatttgacagtaatcatttagttactgaaccctgtcttcatattgcgctaggttgcatatggttttcctgcctgtcccttccaatcacatttcagaaaaaggaggcagtagtggagccttgtgggctaaagtggtgaggagggtgtcatggaagattcaggttcaggtcttcctcttgaagaatgggtgcttctcaatagggaagtggaggaacaacctgggagttgtcagcttgaagaaaatcctgagacgtgataatgggtaggtccaaggaggtcctgagtaggactctgagcacagagcctttctttgcatgtgctgtttttcctgccagcaagaccctctaaaccctttggcctcacccacccccttgcctggttatactcctagccttctttcagatctccaccctcagtactccctcaggaagctttccctgacctcctgacccagtcaagtgcttcttatatatctcctttgtaagctcttctcagttacacttttacatttatttgtgagattatttgattagtgtcagtcccactctttaattctccacaagaacagagattgtgtctgttctgcattcaccatgcatcgcttcatcccctagtttactgcagtgtgtggaacataggacgggctttaaatactcgctgaataaatagagaaatgttggttattagtgaggtattacctaggtgggagagaggatttatatttgggattgctaatcccattaagtgccaagcactgcattaactcatttaatcctaaaaaaaagtcctatgaaatcaagtgtattattccttttaactttaaagacagagaaactgaaatccagagatgttaaccatctttccccgttgacacagctaagtggtaacagtcggtcttgagccgggcagcctggcttcagacttcctagactttaccacattgttctgctgcttagtgcagtagaggacaaagtgaggtgcacacgtgaagtcaggacagatttccgtttgaaaattgtgtattttcccctcctcttcttcattaccattgtcatcatcatcatcatcaatcacttcacaagcaaagctaagcagaaaagaactacttcatgtatcacctcttacattcatgttaactctacattctgccaaagtgatttggctgaatttacccaaagagcaaagtggacatttcaaatcctgattcctagaaaattatagactacatcctgtaaccacctttgaagaaccagcatgtactttaccccaacgtgacaaaattgttttaaataaaaagaggtaatttgactaagattggtatgatctgagacccatggtttctacatcttattcaaaaagcagatccagcatgtggtcatcagtaggtattgagtcataaagctcctggaagaaaatcttaagtttcatcaagaatgccaagaagtcctgggtgtctccaagaatgatagctgttactataataacataattactactggaaaattagcaaagcccaataaaatatggcatgcaaaaaaatatttaccctggaaatagaagtgacctaaatcagtcgtttattccagccacctgcttttagatagtacttaaaaaaaaaactctcaggatggtcatattgtttaaagttctctaggtggaagagtactttacagtaataaattaataaataagacaagttaatgcttttaaactactattatttgttgagcattgttgtaaaggctttacatgcattaatgtatttagtcctcacaacaaccctttgagatactattatcatcatctcccttttacagatggggaaactgagcagtgcccaaagtcacacaaccaggaaatggggaactatcttcaagcccagctggtttgcgcctaaagtccatgctcttacagtgtccctgggtagctgagtactcagttttgtcacctttgtctccttgactttaactgaaagcttaactctttttttttttttttttttttaaacggagtcttgctctgtcacccaggctggaggggcagtgtcttgatcttggctcactgcaacctccacctcctgggttcaagtgattctcctgccgcctgccgaatagctgggattacaggtgcacaccaccatgcccggctaatattttgtatttttagtaaagacagggcttcaccatgttggccaggctggtctcaaactcctgacctcaggtgatctacccgtctcggcctcccaaagtgctgggattacaggcatgagccaccacgcccggcccgaaagcttaactcttaataagagcctgcaatgttcagacgctttgaaaaaaacctaacagacacagttgctctctataaacttaattttcaaaggaaccactattcaaagaagtaaaagggagactgaataaaaagaactaagttctccgtagagcaaatgaatttctgaatcgattgcaaacagttctccgtcatcatgacatcctatgaagtatggtctcccccatgttagagtgccagtgtcttcatgtaccatataacttgcaaatagtatcactgtcttctcacacttcagctttcttctttcatcagtattttggaaagtccacaaaacccagggggctccctgtctgttgccctgtggtctctgtgaaaaccagatgatgcgatgctgacttggactctttcaaatggatccaacagcacatgagtcactggcagcatgttcagctcctttacctcaggaattacccagttcctcattcttgccacccttcagccgtgaagtagtaatatgaaaaatacatgagtactttttgaggatacctcggacctctttccttcagtaccagagactaattgcctcataatggtaacattgaagagcccagttatctgacgtgattgggctttaattatggattccttctggtgtcctattaaattggaaagcctagctgatttcacccaaatgaagcattacctcatgccttgctctcttgcattcctgtgctggtgtcacttaaaagtgtaattacatggtttatttcgtgttctttcactcttgatttattgctgaagaagcccctgtgggatatatcatcataacaaagactgatttcagatgtcaacaccaagaaacacaactggcatcagcaatctatagagagtatctagggacagcagtcagctttggagaaaacccagaacttctcattccccatcccacatttaagggcaaagactttctccttgttaaagggaaagcactgagttcataattagctttatacccagagttttttttttttaaatgttatacctgtttaagaaattttttgtgctttgaggtggtcaagatcaaatttaattagcaaccctcttcgtgattggcttgctctggggaccctgctctttgagaaggaggttagaaggtttagaagcaaacctttgcagcagttctagccaagtgcatgcatacaggccttgaggtggagctgcacagttgactgtaggggagtctgtcctttgttgacgagtgaaacttctctccctgcaaaccctctggggaataatgccaactctgatcagcttttcgactcttggatgaaatattgggttgggaaaaagtccctactaagaaaattgtaccaaaaccctgcttcaataaaatatgaatccatttaatgaagtttatagtagaagtaggctagtcgaaaaggattctgtctctttccaagtattattggcaggtttagggtcttcctcaagtttatatcattaggacttccatcaaagagttatctttaggtgtgattcccatcctccctccctctctccctccctccctccgtcccatcgttccttcctccctttcctccttccttttctacctttctttttctctctgtctctctttctttcaagctgtgggctgcttgtacagatttatgcattttgaattactgcatagttgagagatttggggcttaggttattcagttcttcaaaaagtacagtatgagctaaggagatagggtgaccaactaatctaggttttggctccaaaaaccctgtgtcccagaaaacccctcagtcctaggcaaaccaggatagtagttcatcttgtgaggagattatagtgcatttccaagtatttagctgaatttatcacagggctctgacttgataggatttaagagggttaaaataaggtcttttctgttatgttagtgtgactttagtcttggcactttctcaaggaaggaatccagtctactacaggggctaggtgactaaggagaagaaagaggatatctaagtgttttttgctaaaaatgtcattatctccatgctatttcctttttattgctattgtcatcattttaaagacataccaataagaaataaattactttaaatagaaaactctaattttatcaagcaacagcaaacaggggtgaaatctaaggatttgtacttaaggagtacacttttttgaattgaagaaacttactatgacctgagcatatgtaactcaattatcagaagtcagagagggctactgaaggctcaggttttctaagagatgactggaggccaagtcctcaggcttgagtgtttatagccaaacttcagaaccaggtccctggcaagattctcctgtctaatcacatggcacagagttaggatggactgtttctgcttacctgccttcttcctttgatttccatcaaccaccagtttctttctcatcaatcatttacccagcttttgtgaccaagaattttgatgaggatgcagaggaaggcatgttcttggttaataggaaaggaggcttcatgacaacacagcatcctctaagatgtgttgctccaactttcacaatacatattgtgttttaagtggcctgcttcttggagtgtatcttcccactacacaaaacaaccaccattaacattttcatttacttccaccctgtcatttgttcatcacatacttttaaaaacagggctgtaatcatgtatatacatatatgaataactttatattgtactttttatacttactggcttatcataaacatgtttccatgttgctggagagtcagatatgctaacttttggaatgtgcttcttatatagatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcgggtaagtaggggtatatgatgctgtggaaggtaggaacagatagaatatgggatgcaggaacttagaatgaacaggcccctttcattagggacctttctgagaccctcagatgacctcaaaaaactgtgtaaacttgtgctttcatttggactccaggaagtaaggtgaccacatgtctggatttgcttgagacagcccagtttgcccctgacctaattgtttatagcaccctcttctactcttaaaggtggcccaatttggatgatcacttatatgtggtcacttgacctacaaggtatttgtgccactattaattttttttctcctagaaataaaaataaggacaaatttaaagaaacataactatagcagaaatcatcactttatgtatatttttacattcttgatgatttcttcagtggatttatggtgtgaatatgtagggctttaagtgaatgcataaatatcatttcagctctctgctgcttagaaagtaatgcacagataagaagccaaggaatgcaaatttattttggcattcattaggcttgaaatgtaaataaaaaatgacgtattcatttaagggttgatcaaataaaacaagcaatttttaatgaatgaagttttatagaagtaatttcaatccaaaagaattaagcttttaaataagacatatttattgtgctaaaaaacatgtattttcatcttcctaatacactaaaatggcacacagaataatagtgtagcacacaatacaaactgatatgtgcaatcaataattctaaaaattgttgttttaagtctttctttggaagtccttaaatgcaaaagaagaaatttttaattttgtttaatttttaaaaacatttttcagggttttctaatcctggtttaaatagtttatgctgaaatcccagttaatctggcttattcactcaaaagaaaggaattgtttaaatcaactataattaagctgatggttgcatttcaggctttgaattccgatcaagtttcaaattggttattattttggaggttgtgctttcatgttcctaggtatttctttgtttgactgtgaaaatatttaagtgtgaaaaacctagagagagagctttcttttaagtcactaaaatcggattcttttgatgttagaaaaaaaaaagactctagattgaaggaagaagcttaaattgatttgaaaaattaaagtgtgctttatatgaacttgtttcaacatcctcttgaaagactggcgtgtctcctgttgtatgtcacagtttgttcatcatgtgttgtggaatacccttccagttcctgattgacctaggagagctttgaaatgcaggctaattatcacagttttagactgattgatcacttagtgtttctgcagatttattccagtagggttctgtcagtttgaagtgtttattttctttggtcttgtttaatccctattataatcatatcctttagaggaaattttagatgaagttttctactagtatttattattataaaacctccagtatggtgtctataatttggtgtttctgtggtttgctttagtaatctttcaggattttagaaagaactaatggttatttaaatttgagaccttaaagcgggaatagaagtaaattgtttctaaggaaagtgagggattctttcactcttgtagtgcagtggggtgtgggctcagtagttgggagaactcatcagtcattcactcattcaacaaacattttgagcatctcagctcctgaatttgatcattatgatgtctggttgtagagcagtgagattttctaaccctatataatttcagtgagaaatttaatcaagatgccacttgagagttacaatagactcagtagtcttaacgtttttagtgtttcctatgaaaagtcagtactcactttctaatttgatttttagctgagaaatttttgcttacaatgtttcccaaaatacactatttctttcataattcatttgtttctatctctctctatatatacatttttaagattttcaatgtcaaaacttattgcatttatgtagaaagaacatcgtgctagcattctggaaaccagtattttattcccagtactgttgctctcaacagaggactgggggcaagttacatgacttcttggggaccttaatgtcttccctcataaaatgagagagtttcactacagaatcttatcttcaggctgtttacatctccagaattctggactgaactaacattacgtaatattatgaaataacatgagcaaacttgccacacacatatttatggtatgacattgattattagtatttagttctgacttgtagataagagtatcacatagagaaacttaggaagatagccaaaattatgtcttagacttgtcaatactagaaatgaagctaagataacttgttttcaataatacagattaggcaaagagtatagattcacaagcaagacactaatccaacataccaaaaaagatatccaaaaaatggcaatgagaagacaaataacttttaaattgtcaaaaccaaaagaattactttctttggagtgtttatcttcatctttccctcagtatgaattcttaataaacttagtttctactttcaaaaggattttatctatgttataaatattcatgttttaaatagccaagtcttgattctggtttgattgctgtaatgtaggggatttgtcattttaatattttttaagttagctttaattttgtcttttttaaaattcatttatataattagcctttactgcctttcttggtaaaaaataataataataatcttagtttggtgttttattttaaaccctgaatatcaacaatttgtttcaacatattttagttcgttgacatttttattccatggaaaatatctgtgttccttgactttgctttaggccagttcacttaccagtaatcaccacactctctctgctttctggcagtttagagacatggaatttttttccaattaatacatatagcatataccaactggtaagcactaggagtagatatataaatatcaaaatacagaggagaaacaaggccttcttcagtgtctgttgttcccctttttgtccatgagttctcatcatttagctcccacttacaagtgagaacatgcagtatttgtttttctgttcctgcattagtttgctaaggacagtggcctctagctccatccatgttcctgcaaaacatatgatcttattcttttttatggctgcatagtattccatggtatatatgtaccacattttctttatttatttatgttattgatagggaatttaggttgattccatgtctttgctattgtggatactgccgcagtgaacattaacatgcatgtgtctttatggtagaatgatttatattcctttggttgtgtacccaacagtgggattgctgggtcaaatggtagttctatttttagctctttgaaaaatcaccacactgctacaaaatcaatgtgcaaaaatcacaagcattcctatacaccaataacagacaaacagagagccaaatcatgagtgaactcccattcacaattgcttcaaagagaataaaatacctaggaatccaacttacaggggatgtgaaggacctcttcaaggagaactacaaacccctgcttaatgaaataaaagaggacacaaactaatggaagaacattccatgctcatggataggaagaatcaatatcgtgaaaatggccatactgcccaaggtaatttatagattcaatgccatccccatcaagctaccaatgactttcttcacagaattggaaaaaactactttcaagttcatatggaaccaaaaaagagcctgcattgccaagacaatcctaagccaaaagaacaaagctggaggcgtcacactacctgacttcaaactatactacaaggctacagtaaccaaaacagcatggtactggtaccaaaacagagatatagaccaatggaacagaacagagccctcagaaataataccgtacatctacaactatctgatctttgacaaacctgacaaaaacaagagatggggaaaggattcctatttaataaatggtgctgggaaaactggctagccatatgtagaaagctgaaactggatcccttccttacaccttatacaaaaattaattcaagatggattaaagacttaaatgttatatctaaaaccataaaaaccctagaagaagacctaggcaataccattcagcacatgggcatgggcaaagacttcatgactaaaacaccaaaagcaatggcaaccaaagccaaaattgacaaatgggatctaattaaactaaagagcttctccacagcaaaagaaactaccatcagagtgaacaggcaacctacagaatgggagaaaatttttacaatgtatccatctgacaaagggctaatatccagaatctataaagaacttaaataaatttacaagaaaaaatcaaacaaccccatcaaaaagtgggcaaaggatatgaacagacacttctcaaaagaagacatttatgcagccaaaagacacatgaaaaaatgctctcattatcactggccatcagagaaatgccaatcaaaaccacaatgagataccatctcacaccagttagaatggcaatcattaaaaagtcgaaacaacaggtgctggagaggttgtggagaaataggaacacttttacactgttggtgggactgtaaactagttcagccattgtggaagacagtgtggcgattcctcaaggatctagaactagaaatgccatttgacccagccatcccattactgggtatatacccaaaggtttataaatcatgctgctataaagacacatgcacacttatgtttattgcagcattattcacaatagcaaagacttggaaccaacccaaatgtccatcagtgataaactggattaagaaaatgtggcatatatacatcatggaatactatgcagccataagaaaggatgagctcatgtcctttgtagggacgtgggtgaagctggaaaccatcattctgagcaaactatcgcaaggacagaaaaccaaacactgcatgttctcactcataggtggaaattgaacaatgagaacacttggacacagggtggggaatatcacacccctgggcctgtggtggggtggggggagggatagcattaggagatatacctaatgtaaatgctgagttactgggtgcagcacaccaacatggcacgtgtatacatatgtaacaaacctgcacattgtgcacatgtaccctagaacttaaagtataataaaaaataagcaagtttacaagggcaaaaataaaacaaaaaagaaaaagcaccacactgcttccacagtggctgaactaatttgcactcccaccagcagtatataagtgtaccctcttctccacagccgtgccagcatctgttatcttttgactttttaataaaagccattctgacaggtgtgagatcatatctcattgtgttttaatttgcgtttctctagtgagctttttccatatgtttgttggtggcatgtgtgtcttctcttgaaaagtatctaaaacagtcacttatcttttaaagaaactttttaaatcagaaaaaaggtgtttatatttaaccacgtatttatcatttgcagtgctgttcattctgtttcttaggtcaaaatttctatctggtatcattttcttctgcctcaggcacttccttttattatactgctgatctgatgctgattaattctttcagtaggtgtatgttttcatagctttttattttatctttgtttttcaaagatattttgaagagtatagaattttaggtagacaggccgggcgcagtggctcacgcctgaaatcccagcactttggaaggtcgaggcgggcaggtcacctgaggtcaggagttcaagaccaacctgaccaacatggagaaaccccgtctctactaaaaatacaaaattagccaggcatggtggtgcatgcctgtaatcccagctactcgagaggccgaggcaggagaatcacttgaacctgggaggcagaggttgcggtgagccgagatcgcacaattgcactccggcctgcgcaacaagaaagaaactccgtctcaaaaaaaaagaattataggttgacagtattattctttcacatccttaaactatgttgttccactgtcttctgatttgccttgtttccaagaagtcacctgtcaatctaatctttgttcctctgtatataatttttttttctctctagcagcttttcagattttctcttcctcactcgttttaagcaatttgattatatggatattagcatagtttccttcatgttgcttgtgcttggggttcatcgagatccttagatctctgggtttatatatttagtacgttttaaaactttttggccattattttttcaaatatattttctgtccactcctcttcatcttcttctggaaccccagttgcacatatatttggctatgtgaaatttcctacagctcactgatgacctgttttttaaaaaatcttttttttctctttcattttggaaagttttattactgtgtctgcacgttcaccaatatttttgtctgtagtgtctaatatgttcttaattccatctagtgtattttttcctcttagacattgtaatttgcaatttctatagatttgtttggggtctttttttttcatatctgccatgttactccttaacataccaatgctttcttctttttctgatcatatggaatatataatagctattcaatgtacttgtgtacaaattctgtcttctggatctatttttgtttagtttttgtcctaattatgaattatatttttctatttctttccatgcctgttagttttttattggatgacaggtattttgaattttgtatcgttaagtcttggattcctttttttttttttttttttttgatgtgcttttaaatacgtttgaggattgggatgaagttaaatttgggaacagtttgatttttttgattctttctaaacttacttttaagctttatcagagagaccagagaaacctttactctagggttaatttgacatcattgctaaggcagtacctttctgaattttcaacctgatgctccatgtattacaagatttcttgaactattccagccccatatgtgttacaataatttttctgcctccacctctgtggtggttcttttcccagctttgacatatttcctcacacacagcactcagctgaagactccagtgatctctgagtgtatctctgtttgcggtttcttcctttccggtactctgcttgtgagttttagcctccttggcttcctccaatatttaactgtgtctcctcaacctcagagattgccaggctctgttggggttcctccttcctgtgctgcagcctgggactctttaggcattaagccagagtaattacagggttcaccttatttatttcccttttcttaaagattactgttctgtgctgcctgttttctagtgtctaaaaaccatttcttcatgtattttagatatttaaggttcaaaccagtctgttttactctatcgttacctgaagcagaagactgacttctgtactgtttcatttgttaaccagagtaaatccttcattattcacataataaattaataaggatgatgtttttctcacagggactagattaggcaatatacatgaaaagcatattattgacagtaaagtgtaagatgctacacagatgtttatcattgctattacaaaggagataaccccgttttcctgcagttagggaagttctatatgggagtaaggctgaaagggccaaaagatataggtattgtttctgaaaaactgcctatgcttctatgcatataagtatgtcatgttgcatatttttctgtgctgtattaattcatgcattcctttatcaacagatacttattaaacactcatatgtcaggcattgttctagggactagagatctctgccttcaaggagcttattttctagtggtatattttctgttctgtgtcttagctatccacttttttcatctgcctggacacgtgacttattctgtctctgggcctctggtatgagtgctcatttcattctgccttataactcctattttcttccctactttatctgaccttcctaccttagcttgttcattctttccttcaatccagttgtcatgaaatctctttctttcctctactaattttttttttctttctttctttctgagtaaaagccagagatctggccccctgcttacctctctgaattctttacttacttctgacaacttgctcatttcactccagctacattgacctccttgcctttgttgtgttttgaaaacaccggcgtggtcctaccgcaggaattttgtacttactgttccttttgccacattcatcattcatatgttcatgtcttccccatcgcttccttcaagtttttgctcagttgtcatctttttactgagtgtccttcctgacctctccctactttaaaatgttatgcttttttctactacctctcctgttcctcattcctaccttatttttctggataacacttattgccttctaaattgtatcgtataatttacttctttgtttcttctccgttgtcacactagcatataaattcagtgaaggtagagattcttttactgctgacaaaagcatctaggacatttcctggcactgataaggatctgcataaatatttgttgagtgaatgaatctccttggtaaagtccttttttgtttgcctgttatatttattgaatagacttctttgtttcatgtactttaatttcaaaagtgaatggctggaacattttatatattttcttataaatcattttcattgctttttaagcttatcacatattttgttttataaatatgtagccttcgtgagataaaagattctccatccctgtttacgtgtatacttagatgacaactctaatggtcataaataattccaaccttatagataactcaggagaagatgagattataagtagactttaaatcccattcagaaacccaaggacaattcaaaaggaaaataatcattccaaatataatattcttcttattcttaagaagttgttagtattttgaattttgaatttttaatacagctcccatagaaaatactttaaaatgaacccggtaagacttcctcattaagacatatagacacatatgctcccactcccgtaatcaaatttggaagtcaaataagctctgaaaaccaaaacattcttccaagtttattgcagactcatttggtagtaaaaaccaatctgacctgatgtgtagctgtttatagtctttatttttccatttggtgagtccaattatatatttcgctgaggaaatactaacatgtttgactacattgtgtgccccagacctgcttagagtattatgtaatatgcagtataggccatatattgcctttttaacatcaaaaataccctaaattctgaaatgcatgtagccccaagagatttgtataaagcattgagggcctgtgtatttttttttaatttacaagtgaagccagattccctagacattaagtgcctaacttttggttgttgttgctgctgctgttactgttttttctccagcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggaggtaagcatcattttcctggccttgatcctccaaggggtccaggctttggttttcatctgtatgaattatatgttcatctgcatcccttccagtctctaccccacactgctgtcaccttttccttgctcagaaacctttgatggcatcctgctacttctaggataaaaactatagctccatagcctgtcatacaaagccctgcttctctggccccagcaactttcagcctcatctccagcccaccttgcatcctcctctcgccatctctgctctctgaataactgaggcatatttatacctttgtatgtgtcttcctttaccaaaaacaccccaccgtttccatttcaccctctcgaaaaccaatgcagaaatcaagactttgtctaaagaacacctctgttttaccttccccaactcaccttattataaggcatttttctttctttgggctctgcagacacattataaactattatctttatcataaaaattgtatgattttccattttcttgccttttctcaaatttttttttcaaccccattccctgtcccaccacatgccccatttctacttttgtattttgtcctttactctggccgtccagtcgtcatctgatactcatgtgattcaaaaccgattatcagttttccactaaatatactccatcttctgatacccagactcaaaaccttcccatcctcactgactccccctcctcgcctgtgctgcgaggctgtggtccagccattccgtgctctctggcattccacactacattccattttcattgttccacttatagtagtcttctccctggtctctgtccctccccacttctaatcaagtttacatcttgtagccagatagatattactgaagttctgtatcttgttgctgctccgtgtctccgttttgcctacaaaatccaaattctgtaagttggctttttggatctcccaagagctggcctcaggctgcatttccaatctatttcccgttttgccccttcaggtcaaagtctactacttggtaggagcaccatgatttctcactttcctgccttggcacattctttctatttttgctctctcctcttcctggaatgcctttatccactctcttatatgaatgtgttcaaattctgccaccttttcaatattcagagcaaatacctcttctgctccaaagccctctgaactctctccttctttgaaatcccacatcacttcatttgtagctctcttgtagtacttgtctcttgaatcactaccttttatgatattatagcttaattatgactatatccatcagcgtgaaaactccagcaggagggaaggaaacagatgtccctgagtcattcagttccttcagaagttgtttttgagtacctactatgtgccaggctgtctgcttggcactgtggaatgagctcactccctgtgcccaagcagctcttggaataatttgcacacttctcaatacagctggtgcctagtagggttattcaattccattccatcacatcctgtgtgcctttaactcttactgtagagaggaaagggaaaggtgggggaaggacaggagaggagggaggcgatctgatacacggaagagagtttttactgtaatccggagaaaatgcaggtcttctttgatgcctttcatattggatgacataaatgagactgtttttaacactttattagcaatatgaagagtttcaaaagaggaaaaatgggtttttattgtaagtttacattatttgggctttataaaagcatggtcttttaaatgttcacacttccctgggcatgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtagtgagtacttcacttccaacagggggcacaccaagaatagacttccagccctgccctgccatttacttgctagctgagtcctggggaaggtaacttaatcactttaagcctcagctttatcatctgtaaaatgtgaataggaaaatctagcttgaaaggttgatgtccaggttaaatgaggtattttaagaggggctcaatacatgtaattctttttcctttgatgtacattttttagtcttttacatgaaatgtcacatctcatcttatttatgaatgtcttgctataaagatatatggttgatacttttagaagggagaataatcccaattttctttggtggtggggggactctggaaaggagtttataaaagacaactattattcttacccattttctttcccatatgttactagctttatcaagagagaaacttgaagttaaatgaatgagtagcatagacagcatgtgacttcaaaatcctatttcaagccgggtttggcgtcatgccctgtagtctcacctacttgggaggctgaggtgggaggatatggagtttcagcccagcatgagcaacataatgagaccctatctcaaaaaaaaaaaaaaatatatatatatatgtatatatatattaatttatagttcctaggactttttaagagttttacagtaaccttcagcatttaccatgcaactttcttgtttgattatgcataggattgattagacaggtattttcaaaaagcctgcaagcatagtactcagactcattgaaagtttatagaatttggcctgtgtggaaaactctgtgctccaagtacaacaactaactgaattctctaatttaaacaagtttgaagggaagtgaaaggttataaaatgatacagactcataccgcagaatcaccttaaaatgcagctgttggagaaaaaaaaaaaggaagctttatgctattaccacaagaaagttttgcctcttcaccacacagaatcctaatttagtttgggaaaaagaaacataacatccccattttccttacctgtaaaataaaaggtagtaagtagtttaagaaaactgtacttttcctaaagtttttaggactcttgtaaatagaataatagcagaatcatggaaacaaatttggaattgaagtcttgacctcattgaaagcccagaaatcaattagcttggtacttcccaatacatcagaaaagctctttctctttttgtgtcagtctctctgtgttagagggagaaacaaatacctgttcctttctacctcatttgttttggtgatcataaatgacccatgcccaagaagtgttccgagaatttcagaagccattcttgttttatttactttgttagtgaaagcatgtatttaagctttgttttggtcatgtgtgctaaggggagggtcctacctaaaggactggcttgttgagctgaggattaatcatgttatttgttgtttttcccctgtgaacagaagcccccaatgcatccaacttgaaaattgtaagaatggacaggacagctggatgtgtgactggaggggaggaaatttatcttctttgtgacaaagttcagaaaggtaaatacattctgtgatctctgatctcaagaggtgtgatcttgacacactacagttctgagtgtgtctgtgagtcacatttcagcagtggacaagaaacatccctctgctgccacagaaagtcttaaaaagcatttacgttttacctcttccaaatgtaaattgtctgtgttattttttcctaagtcaactaaatcacttttagatttcccatggaagtaaaaagaaataagaaaaccgtgataattataatcagtgactttcagtatctttatacattaaaattaatatctgtactttgttaaacaaaaataaataatagcccattcttgacacacatacaaacacacacacagaataatgttttacatagtattaaattgtttttatttcttttgcaatgctttgatataacactgagagaacttctctgaacacttccacagatgtgatgtttaagaaaaggaaagaaaacagggaatacagggaaattctcagagcacatttctctcacaattttccctttgaggaaaggttcttggcgtttatctttcattagatatattacaacattgatagattagtaaaagctgaggaaaatgtgttattttctcaaactgcattctttttttaaataaaatgatagttggaaagtgtagtataatatctatttactacagggtgagcattttcaaagtaagcagatacctaactgaaaatataaataagtaaaataaatcaataaaagacatgtggcttttaaaaaaattatcatatgagattaaattctctgaggtatatagtcagaaaaaaatgggatcagattttaaagtaaacacatatatactttatccaaaaaaatttacaggccaggcatggtaactcatgcctgtaatcccagcactttgggaggctgaggtgggaggattgcttgaacccaggagtttgaggctgtagtgagctattatcatgctgctgtactccagcctagatgacagagcgagaccctgtctcaaaaaaaagaagtttacactttctctgcctacactagtgtcagccttcttccaatccactctgtccaagtaatactcatttccagattcctgggtgtacatactgtgagtaaacacaatctgagtacctttatttgtaaatgagatccttagtcattatcattacattggaatggcttagtaagaaatgtcttgtacttggcttaaagaatctcaataactaggtccagtgtagtcctacctgaaggcaaaggagattgtaagatgttttatccattcctagtatttctaaaattctacttacatagagataaaaactttgaacaaagtcaatagtgtggccctttctatgaaacggaaagtgaagccaggaagatgccaacctaagttacattgtcacatttctgtagaagtgaatagagtatttataaacatgctgaacatggagtatttataaacacactccatgactagagtgtgcaatttaagcattgcattttaattagaagggacctgattattatagtattttgaccaattactcaatatgaactaagagactattatagtgagacagtttaatagtgtgttaagagcctggactctgaaattatactgtctatgttaaaatcctggttcctccaagtactagctgttcagccttggataagtacttaacctctttggaccccagtttctcttttgcaaagtgaggataataatagtacccatctacatcacaaggttgtggtgaggatgaaatcagttaatatgtgtatatatgaagcacttagaatagcatctgccatacattaatagtaaaacttatataagttaattatttttatgtacatctatatattgaattgcactgcctcgttggattctaatattcttccaccatcgttcgtgtttctcaggattggcttaaggatggagaagcagtaaggtcaaagattaaaagaaaattcaagttaactaggtaaatctagtattctgtcattgtgaatgaaagttggggcgcattactgtggtaaataatgaaaaaagtcagtgatttgtgaagattttaaaagactgaaccttttgatcttgttttttaaaagtgtaaatagatagtaggtagaatattaaaccagttttatttttcagcatgtttataaatactatttacactatgtgaaattacacacttcaatgtgattgtttgcagatgacatccagattcgattttatgaagaggaagaaaatggtggagtctgggaaggatttggagatttttcccccacagatgttcatagacaagtaagtgatttattattattattaatccttattatttttagagatgggatctcactctgacacccaggctgcagtgcagtggtacaatcacagctcactgtatcccccaactgttgggcttgagggatcctcctgtctcaacctaccaaatatctgggactacaggcatgctaccatgcccagctagtttcttcagttttattttttttgtagagatgatgtcttgccatcttgctcaggctcgtcttgaactcctggacttaagcgattatcccacattggcctcccaaaatgctgggattataggcatgatccatattactatcatcattttatactttctgccttattgaaatttagtacttagcttccatctataaaaaagaaaaatcataaatatttaacttccataaaacagtactatttttaagactcatgcaggtcatccaaaaaagttacctactgtagagttatgggcaaggttctgttagatcgtttgctctgagatgttggcaagatatttaattgctgcctaatcccctaacccataagacagtgccccacaggtcctttaatgaaaatgtttttaagtgttctaccaaagtaattatgatgagacctattttatgatagcacctaattatgataacaccttaaaagggtgttctaggagtcatcttctaattgaagctgatgtcatcctgttaaatgaagatttcccaatggcaactgattaaatgatcagtttaatcatttaataacatgataatgctgagcccccaccttaattattattctcctatttacaagtaattgaagagtattctcctatttacaagtaattatctggattggaaacaatccagatattcatcagtaagtggccagttaaattatggtctgtccttttgatgaaatatcatgtagttattcaaaagaatgagtactctgcgaactaatatagaaagatctcagttatacagtgttaaaatattttaaaagatgggtgtagaacaaagtgtgtgtagaaatgattctatgttcatgcataaagaaattctggaaggatacctaagaaattaataacagtatttaccactggctggtacactgtaggaactgcatggatggggaacaagaatgtcaaagagaataccactgtatgcttttttatattttataagatctttatccctgtgaatatattacatagtcaaaaaatcaaactgaaaaatgcttaaatccctaacataccaccaagaactaatgtgttatgatgccaatgtaagcaatgtttagtttcttctcttcatcactggcctgtagccatctctctctttccatacccagtctttctgatgttgctctaaataatcttggaggcttttaaggctgctttggaagagaagaaagtatatgcagtgaattttataagcatgatatttacaactagaagacatttgaaatagacaaatgaaataataaagcttcgtagtacattagcatagcattgtattttgattttacagtagcaatttcataaaaatgtatcggtatagaattctgagtttggaactttctccaggacacggtgttttttagtacactgtgtctaaacattgggtataaagaaaagcataaggaatgtgtttaatgagtagcattactgcaaaaaaaaaaaaaatgtagtcctacaccaacatgtggttcttcgtatcctgcagtttgccattgtcttcaaaactccaaagtataaagatattaatattacaaaaccagcctctgtgtttgtccagcttcggaggaaatctgacttggaaactagtgaaccaaaacctttcctctactatcctgaaatcaaaggtaagtcagttgtttaaaatcttatgctcatattttattttattttatttttggtttttgttttgttttgttttgttttgagacagagtctgactctgttgcccaggctggagtgcaatggtgcaatcatagctcactgcaacttcgaactcctggcctcaaacagttctcctgccccagcatctcaaatagctgggactacaggtgtgcgccaccatgccgggctaatttttttttttttttacttttaatagaaatgaggacttcctacattgtccaggctggccttaaactcctggccttaagcagtcctccggccttggcctcccaaagtgctgggattacaggcttgagctgccatgtcttgccattgtgcttgttctgagaagaggacaagctaattagaaaagatcagttagtcacctcctttgaacagctttctagtaacaggtccctggatccatggtgcttatttttagaagagacagtagtatattattttgaggtcatggaattagtctagctttttaaaataatgttatttccaccaagcttatatgagatttagacattgagaatttgtctttgaatttgagaatctaacatttattgactaactcagagttcaagcagctgagatgaaaaaatcaggcttgctgtttaggagaatcagccagttagtcaaccagcctcaggcggtggaacagaaaacttggccaacatgcactgtgaaactatgaaaatgagtaaggcatcattctttctctcacaaaagatgctttaagaaagggcactcataggtttcttaaatagttataatgtaaattatgattttaataagtaccgaaagtgaagcatccataaaaatataagagaatgttgaagagagagcccttggtccctttattctaaagcagcctccaaaaagaaggcttcgtcaaggagatatcatttggccctcagcatttggggtatatttcagcagttgggtgttaaacagagaaggagagggttctctaggtttaagttacttgaggagcttaaagagagaggtaaacacagcgtttatgcagagggaaaaaagtgttctgagcgctcggatggacatgaaggccaatgtgggtaaggaaggccagggccaggctaaagagggctgtgaatggcagcttaagaattttgcattaattctggagagggatagccgggcctgcctaggtttggaatgatggctctgacttctttatgtcaccactgagggtaccatttaggaggcagatgatgagtcagaagagtaatgcaagaatccaagtgagaaacagtgcagttagtaaaggtcctagtgccaggaatgaaaggagatggtggacttaagagagagtgcagtgatactgtgatacagtgatactgtcaagagggcctagaggtcggaggtgtaggagagacggggagtcatagatgggtctaagactccctgaccaggaagcttgtgatgtggttgacttgatgaaaggaacaagggagcaaaagtagatttgggtgggaaaagaaggagctcagagtaaaacatgttatattttaggtccctgtgggaaaatcaagtgtaagttcttagtaggcagatcaaaaggcagaactggaactcaagagaggacagggtgagaaatttagcattagaatcatctcaaaacgagatataacaggcaccaactgagtcatcattcaaaggtatttcttaacctagagtccactgacccccaaagagtctgtggatagaaatgtactttgatatcatcagcttcttttataatcctgttttgtattttacatactgaaaaccatgattctgagaagagatccatagagttcaccagactgcagaaggggctgtggcacaaacaaaattagaaacccctcagttggagggaagtgagactgggaagggaggtcagtaaaatgattgccacggggcacccagatccttgctgaggttggaaaccgcaaaggtgcagcagcaacaagccacatgggtgggtgttgtctcctgtgagagcaagatgtgataggtaatctttgaagagggctttcctttcctagaattcgtgctgccacaggagtgtttagaaaacggttctacaagttcttgtttcttttctgaggttgtggcctctccattgtttggtcagatttgtagtgcactctatatcctggtggtttgaaaacattgtcagcacaataacttttctttcttcacatgagatttcatacaaaatcccagtgtatggacatggtaggctttgattaaaataggggtgaagggccctgccagctcggccttccgagaggctgtcccacctctccttacttccctatcaggagctgctggaggtcttttgaatgcttctgcctacacaaaatgatgtgaaaatcactgctttaatttaaacacccttctttaaaagtagacacagaagaaaaatatggataatttttttagactttctgaggaaaaaaatagatttcttctccagaaatatgtcttcaaataatgccagtttttgctaacacagagaatcatgaagaaagaaaacccaggttacctgtatgtgtatgaacctagaaacattcaaagctcagcttggtatctaggctgcctgtctccctttcccagtggtatctatgcctcagaaaagtatgttatagtgggggtatattcaggtgattactttaatgcctcgttatcatagtaggaactatccaatgcagggattagagaatggggtcacctgaaagttcaaaattgcacctgtatgcttcatgcacctaccttccaggctgtcattgatgaaaagcttcatacaatacaaagtttaagaactgtctggagaaatacttacccattgagctctgaaggaaagaatggacaacatatatatatatgaggacaacaaattacttgattctatagaaaccttctggattataaaaactcaagataataggaccaaggagaaataatctgaccaggcaatataactggtcagaaaagtagtaggccatttagcattagagtaagtagatagaaatggatccaaactgtacaacccagggaaacattgcatacatttctcagaagtcattgaacacacttttccttacccccagtctctgtagtcattccctatctcattgcctaattttatgttcttcattatttttatcaatatgtaaacctgtcttatctatttatttatgggtctattgtcttcctaccaccccgagtacaaagaatcttctttaggtcatagactatctagaacagtataagttgcatagaaaatgctcattaaatatctgtggactgacttattgattgaccagccaagctgccatccatcctcatctataaggctagtaatatgttgggtatcatcaggtaagacattatacataaatataaagcatcatacagaaccagcccggagctttgcatcctctatggtcatcaacattgtacttcacaaaaaattattggagatggttgggtccaggggagacgatcgaaataatcaagagaaggatgattggcagaggaggaagatagttgaggaactgctgtacaaaagcaaaaaaaaataaaaaaaaaataaaagagaccataatgatttttcagtctgaaagatggagattagggataaataatctttaaattatgaaaggtatggccaagataaatgcagtcacctttactggtaaactaaaacctgaaaagtgagaatgaggtacttttaaggcacatgcacagaaataggtagcaaacactaggagattatccatatttgtgaattgaactattatctaaagtcatcaactgttatgtaaagtcattgattattaaagtcactggttattattatacaaagctattttggagtgttttcaaaagaatgacagcctaacataatgaaaacatcactgcactttgagactgatcttgactccattgtgacctcagataagtcacctaacccctcctagcttcagtttcctctcctgcaaaaggagaacttgtagtaagtggctgctttggttccttctaaaataggttgatgtttcatagtacatcccatggtgccattgtcaaaagcagaccgcaaggataaatgatcccttgaatatggagtgtgaaagtctccatattcaattctgtggagattcaaacagcaggttcttttataaagcttatgtggaatgttctgtatcagtttcttgtcattggaatcttactagctgtgttataattaatattttgcccttaaaattcccattttacagtgaaatacagccaataaatatctctctgctttaaaaggtaaaatgaatacatagaaaatactaactagtctctttgctggaatccatgtcaatagataacatttatttctgaagataaataagttgcctgcttccctcttgtgtttcatatgtctgcagtgaacagtaatgagtatagctgtaaattagttatgatataaccgatggggaaattataaatctgaatctaaaacatatttgataagtaagtcaaagtttctccacttaaaggtcatccccttctagtggaagcatatttttctcaaaatttggcaaccttggttttttttttttcctgggaagtctggagatgctcagcttttaaacaactattaaagtgtactttgttaccctgctttcccctgcttcatctttcaactgcagttagatgatcatgagataatcagtaaacagagaccttctatctagccctaagatgactgaaacaaccacagaattagaaataatcgaagttctttctgaacataagcatgacaaaactgacattgaagaatcagaaatagaataattgttaagggttcagcactaatcaaaaaaaagaatacctcattgactgtatttaatttgaaaaaacgaaataaaacctccttaactgctccagcccaaaaaaagagaagaaaggtatatgatagaaaaagaagagaaagaaaaggaaacagaaaggagaaacaagaacacagtaacaccacataggcagtaacggaactcaaaagggcattggggctggtgagaagcacagatagcgagaaacagaaagatgaaaacaaaacaaaaagaaaagcaatcagaagtctcagagggcatcactgtattgtagtcaaatagtggtcttagacttttagccccagtatctcatcagtcaccagaggttacagatcccttggttactgtttttctggcatccaccccatttttattatcctggtgaccactaaggaatgggcctccatcacttatgtccgcattgtctctgcctctcactttaactctttagtatgtcccacacacacgtaaaagatgaacttcctaaaataccatcccctacacattatttccctgttcaaaaacattcagcagctttcttgcctgtaagttcattctccgggtgctccgcagtgttgtcccaaacagttccatttctcaggaattccttatacagtcatagcttgtttctttatattttgcaaatactgtgatttttacaaattgaaggtttgtggcaatagtgtcaagaaagtctattggtgccatttttcccacagcatgtactcactttatgtctctgtgtcacattttggtaattctctcaatactcgaaacttttccatgattattatatccattatggtgatctgtgaacagtgatctttgatgttttgggggtaccacaagaagtgtccatgtaagatgacaaacttaatcgataaatgttctgtgtgttctgactgctctactgactggcaattcctccatctctctccctctcctcaggcttccctattccctatcacacaaccatatggaaattaggccaattaataaccttacagtggcctccaagtgttcaagtgaaaggaaaagtcacacctctcacttgaaatcaaaagccaaaaatgattaagcttagtgaggaaggcatgtcaaaagctgagataagcccaaagctaggcctcttgtgccagttagccaaggttttagtggtctgagtagaagattaaaccagccacaacattcccttttaccaaagcctaatccagagaaaggccttaactctcttcaattctatgatggcttagagaggtgaggaggctgcagaaaaaaagttggaagctagcagaggttggttcatgaggtttaaaaaagaagccatctcgataacgtaaaagtgcaaggtgaagcaacaaatgctaacagagaagctgcagcaagttatccaggagatctagttcagaaaattgatgaaggtggccacaccaaacagattttcagtgtacaagaaacaaccttccattggaagaagatgccatctaggactttcataactagagagaagatgtagaaatgcctggcttcaaagcttttaaaaacaggctgactctcaggaggttgaggtgggaggatcacttgaacacagaaggtcgaggctgcagtgagctataattgcaccactgcactccagcctgggcaacagagtgagaccctggctcaaaaaaaaaaaaaaaaaaggcagactttctcattaggagttaatgcagctggtgactttaaattgaagccagtgctcatttatcattctgaaaatcctagagctcttaagaattatgccaaatcttctctgcctttgctctgtaaatggaacaagaaaacctggatgacagcacatctgtctacagcatggtttactgaatatttttaaacccactgttgagacctactgctctgagaaaaaagaaaaaaaaaggattcctttcaaaatggtagtgctcattgacaatacacctagtcacccaagagctctgaaggagatcttttcatggctactaacagccattctgcagcccatggatcaaaaagtaattttgactttcagtcttattgtttaagaaatacattctgtaaggctgtagctgccgtagatagtgattactctgatgaatctgggcaaagtaaattgaaaaccctgtggaaaggatttaccattaaccacatttgtgattcatggaaggaggtcaaaatatctacattaataagaatttggaagaaattgattccagccctcgtgggtgacattgaggggttcaaggcttcagtgaaggaagtaacagcagatgtggtggaaatagcaagagaatgagagtgagaagtagagcctgaagatgagactgaactgctgctcatgatttaactttcatggttgaggaattgcttcttatggatgagcaaagaaagtagtttcttgagatagaatctactcctggagaagatgctgtgaacattcttgaaatgacaataatttagaatattccataaacttagtaaagcagcagcagtgtttgagagaattgaccctagtgtggaaagaagttaaaactgtggataaaatgttatcaaaacagcattgtatactatagagaaatcttttgtgaaaggaagagtgaattgacaaatttcatttttgtcttatttttaaaaattgccacaaccacccagccttcagtagccaccacccttatcagtcagcagccatcaacattgaggcaagaccttccaccagtacaaagattacaacctgctgtaggcttaggtgatcattagcctgttttagcaataaagtgtttttaattaagatatgtacattgctttttaagacattctgttgcacacttaatagcctatagtatagtgtaaacataatttttttgtgtactgggaaaccaaaaacatcatgtgacttggtttgttgcagtaatgtggaattgaacctttcaatatctcagaggcatgcctgtactaaactttcacttcagccaaacttatctactcctgttctcaaaagcaccctgtgtacatcttctttttcctcttcttatataaaactgattctgagaagcctttcctgaatttcccatccctcagtgaactcctaaaaggttttccccaaactcctagaacactgatctgcaccatgaatttaatgtatgtcctgttatagtgctgtctcactaagtctttcccccactatcttaaaattatgttggagggttcttggcagcaaagacattatgtcatgcttttttttatttccagcatttagctcattgtagatgcataataaatgttaactttttaacatgagttattttgtgtgaccaagcaaaagggtcaataattttttaattcagcatcttcaggatctttttgatggataatcaaatatttcactagttttaacaacactggggacttaagaaactgttgtagagtggatttgggtgtgtactgctctgtggtctctctggagctaactttcagccttcatacccattggaataaatataacgcttcttgaaatttaccatctcttcctctttgagtgctttctatttccctttaagatgtttaaaaataccattagaatcagtggtctttctgtggctagtggtgggaccaaatcaatcttttctcctctggtttctcttcctttaaatacagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccaggtacaaaaatacttattcttcctaaaactttttcatattggagagggtagaattttcttttctttggtttctgagcatgtctgtgagttgagtggctatgatattattgagtatattaattaaaatttcctgacaaatgtaaatttatttttcaaagaaatccatgttcattttacaatatgtaggtaatctcaaaagtcattaagaagaaaaaaaagtaccccaaagccagttatttaatgaataccttcctaaagattttggtatatttctcttttacattttttgacatagttgtcttgtttttgtttggaaacattgaaaagattgtatattatcatactacaatatagctatatattaaacatctctatatactacattgtagaaactttgaaaatacataaaatctgccatcaaaggttaactactactatttttatgtatatgttatagtatatatttgtaaattttaccctgaatacagctgtgatcatcattatgcattttattttaatccatttatttgcaatactattttactatcatttgcaccatgactgtgtgtatagagtcataggtgcaacgtttacctgagatgttaacataaacatttcctccagtaatatgaactttaagcataaattttaagcatcattttaatgactcatttcctcaagtgaacaaaccatagtataacttacttacatgtagtttcctgttttctatataaaatgctatactgaacctctgtccacctaacttttcacttattccagattacttttgtaaattagagtctttgtagtaaaattactacgtcagagggcatgacatctaatgccatctgttttcccaaagagttgtaccagtttatgcttccaccaaaaatgcctaagaatgaacagtggtggccatttttccattgaggagtcagtatgtttttctgtgctttgtttgattaagtttttttcctcaaggggttattttaatgtcttctacataggcaagtctgagtttggttggtgaccctcactattagcctctccccttcacataggagtgaaggctttctccattacaacccctccccaaatctggggtgctgtcagagttgccaacatgtaaactttaccaaagtggaattctgatagtcccatgacccccaccatgtgtcttagtcccaacagaaaaaccatgtgtgggcacaatactgtcctgtcacaccaaaggctgtgctcacctgagagacagacactaagttgtgctgagtctttgtaaaatatcttcatgatgtttcatttgttttacttgccgtttcagggtatagcttcccacactatggatttcctacttatggtgggattactttccatcctggaactactaaatctaatgctgggatgaagcatggtaagtaatgctttgttcttaataccaagaaaggaaaaaaataattaatgctaaaaagggtttttaaaatcattacttatcacaacagtattatcatcttgacaaataattgatgaatgcaaataaactaagaagatacttttcccaaaagatattatttcctgtggctagtataaactctattacttttatatattttatatatttactttgtaagtggcatgaacagaggaaagaaaagagcattgaaaagagacaacagagacctgactattcaaatattttaaacatcatcaaacttaatgtattctgtctctttttttctcaaatagtacacttctgaaatcattttgagttttataggatcggtcttttcccatcaagtcatcccctgagaagctgcagttaaaccacatgttgatagtttatattacaggtccattctagtgtacccatggaagaaataatactataaagaagtcttcccatttattgaatacctatttttgtgccaagtgcttttacatgttttaactgttatcttcatgactgctctatatggaaaatagtaactccattttgcacacaaaaggcatcaaagttcagaaatgttcgtactcactgaaggcacacagaagttagtggcagaacaagaatttgaagcaggtctcctgcagaaaagctagatgctctcatagtatctgtcagataacatagttgaacctgaaagagggtgatcaggaatggtacactggataactcccacactaaagaatgtgagtcgacaacacgtctttatgatttgctttgttcattagcattaggaaaaaactgctctgttttcaagaactttaaaaattcagctttcctgcaattcatagaagagctttatttcatttttctcctttacaaataagcaaaatgagatttaagattttagaagtatactaaaaatgatttttagaaatgagtttagaatatctccaaaacatggtatttatgatatgaccatttttaaaagaattttaaattattatttttcttttccttttgcagcaaacttgtctcttacctttatctgacctacattggaatagcgaattatcactaaatacattttactgagaaaaatctgatgtttttgcatttatcttaggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcagggtaagtgagcacacaaattacgttctgttggttggctggggaggggtcagtcctaggtgcagaaagatatctgctaatctaaagatgatatatcaatatctagtttagtgtactcttcaaagttctgtatgcctttggaaaagcatatgtcagatcattttattcacactgggatttccatttttgctctgttatctttgaatgtaaaggacagaaatttatatgtacattctccagtcataatcatgcagttttagggtattgtgagagataatcaacttcttttctggcacagataaatagagaagtatttccacaagcttaatagtcaccctgtctagattctggcttaaccgtcatactgaaatagaactttgccttaaaataggaacttttctttttatcttgtgccctctttgaagaagtaggattaggagaaaatgtacttttgcgtttactgtgaaccaatacttattagcatatgtgtcatgattctaggtcatcctagatcgtactaagaagacgtctataaaagcaaaggtagtaaatatttagagttggtggccacatgtggtgtctatcacatatgctttttttttacacccctttaaaaatgtataagccatgattagctagggagctatatgaaaagcaggccataaacaggttttggcccaaaggtcacaaatgccattccctgaccttaatggaacaaactttacaaaaacgtgagtggctcattgaacgtctctgtttatggcagagatgtgtgttttttcacacattgcctaacaagctaattgttagagattccaatgaaggattatttcaccaagatattggtgatttaaaatcatggtaaaatctaacattgtttggagattgttttccttaaaataacagataatggtcgttcccttaaaataatacatttctaaacttttttcctctaacaaatcatacacagattctttaagatcaatctctaactatatttgtcagtgacccagtgtccaattctgctttttctagtccacacaatccaaaagcattgaaagaacattttcaactaaaatgatatgtcaaggtgtcagaacactgatgctggtcagtttgtccttaagcatgccatacccataaaacaaaagtaggaacactcaactatgattgtggtcattgccttacagataacctctttctagagaaggctatgcagcttgcaaagaggcatgccaatgcccttttcgactacgcggtgacaggagacgtgaagatgctgctggccgtccagcgccatctcactgctgtgcaggatgagaatggggacaggtaagtcagaacttttgcatgataggttgtcctgggtggggaagaagaagagcatcgtataatgcatactgactagagataaaaataattgttcaaatatattgagtcctctaactggaatgatgaagaaaaataatgtgtgaataaggttaagtagcacaatttgctgctccatcctgctgctgtcatctgttggaatctgtagtagctggaggactcatctaagagtgaatctctctgggcaagaaaactaagatgtgtgtaggtaatggtactttttgaaaagccttgctttgtttattgaagtaatatttggagaattgttaagagtcctaccaaatccctgaagcattgttatcccagctgcatatttatgacagtgtactcaagaaaaagcccaataaaggcagcaacaacaacagaaagattaagagggactggtcattatttcccagttactggtttcttctctgctccctcttctgatggtcatcagtctatgactgtttcagacttttgtgactgctccagcccatatgtgggagtggaacattccaaacaccatgccttccattcttgctattactgagattgtatttgcaaagccacctggcttctttctaaaacagttctcttagtcctttcattgagacttctaaaatgatctcaaaagcctataaaaataacaagagacagcagccttcacattcaagtcaagtgccttatctaaaaccttcctaaaatagcatcaacatagagaaatccttttctgtggaagagctcttgagtgctgtgttttagacttcagtttaaaaattaaaccaagcactttaggaaagtaacaacctcagggtttcaagcagagacacctttgttctcattccttgcaacgtaaccaaggatgtggtataaccactggccttgttatacagtatgagaggaaccagtacaaccttcttggtataaagccatgaacagcagaattctttttcagggttaaataatccagttagcattcagtagcatacaaccacaagaaaaagcagttaaccaagacagtacagcagtgtttcaagtggcatttccagggacctgttaaattgataagtctaagaagatgagcacatacaggttagaaaggaagtgctgatatctgaagggaggattgttggaagggatacaaggcgaggcacatgcaagttccctcctaagacccaagcacactcacacaagccggctctcagagaggccacagatttgggacttggagagaccagaggatcctcataagagcataggtatagggcagcttttggccatcacagcccaagtctcttgttttaattcagctcgtcatatttggctaatagtttaaatcctgtggccattagtcatcatagaaaatataataaagaaaaatatataaaacttctgctattggggaaattcccataagggtgtgaggatttgagggggagggggaatgtacttctgctatgaaatgctgagcggcacatggaaattttcgagcagttttagaagtatgacctttttcttggtgtatgtgcatcatgtctatgtcagagtttaggcccttttcagaagtcttcttccagtatcacatttcaagaagcaatagtgaaaccctgagatcatccgttttaaaatatttctcaagtagcaaaatcacaatttagttttttaggctcttctgtgccggagttaatcccaagtacgatatacttgctattgctaaggaagaggcttgagtaaagtggcacctgatagcttattttagagaagatccagcctgtacctcgtgtcccagatgtagtgctgctgcgagatgctttagtgtgctctgcacctcaatctgtccatgctctggagtggtcatcttcttagacattcatctgaatgtctttagaacagtgcacatgtatcccctatgcaggattgcttaagggattaagagatggctttggagtaagacaggcctgggcttgaatcccagcttcaccacgtattggccttgactgagttatatgacgcctgcaagtctcagtttcattagctgaaaagtgaagataatattacctaactcataggattattgttatagtaaaaagacaatatatatcaaatgcttagcatagtctggtaaatcaaagctcccaacaaatagtagccactggtaaaatgattgttattgttattgttttgaattttaatagtatgttttttaataattaaaagaattacgctcctgtgagtgactttgacaccaccagtatgttcagcctcattagcgtaagctcttaagttccttctatcattcttatttttgtgcctctactgcatgctagggttgtaaggctgactcagacagaacctgccccagagatgacaggacagagaacgagaaaaatgtgtagaaaactgcagttgcataaccaagcagtaaatttgagagggacaacttgctccacctaggaggttaggaaagtattctctgaggatgtcaggtttgaactggaatataaaggatggagtaggcattgttcaggcagaagaaaggagcaaaaacattccaggcagagggaatatttgctggaatgtttgcaggagtggtgggaaatacaatcactttgtttcttcacaagtttactgcaagaattttcttccagtagttaaaagcttcactccattctccactcttgggatctggaaagatctttaaaaaaccaccacactgtattttggaggagggcagcagggctaagtgaggtaactaagtttttctgaacaattcctagtgccaggcattcattttacatagaatctgtgtgtcaggaaaagtcagggggaaaggtagagaagaaaaccgcccaaagccatggtatagaggcaggattgggatttaagcttaggtctttctgggctggaagcctcagtgtgtttatacatcaaggggtcaagacctgaatgctcccagaggccaggaaggtaccacaaataacgtagcagccttgggtaggcagttgggagggaccagtcctctggagacagcatcccacctcagattcaatgcattttatagattcaaaacattttagggccaaataaaactaggtatgagagcagattccattcttgagtctaatcacatcttgggaatcttttctttttcattaacattttagttaattattgccactgtgttttcattccagtgtcttacacttagcaatcatccaccttcattctcaacttgtgagggatctactagaagtcacatctggtttgatttctgatgacattatcaacatgagaaatgatctgtaccaggtaagcagaaatctcaagaaaacaactgaagaaaaatctgtagtttactttttcttctgttatgtttgggtgcatgttatttttagtaatgttaacagtagcaaaaacaaaaacaaacctttgtaggtaatatctaaaatcccattagttgagaatgttactttatgatgtaggatcctttgatctgtgggtataacagccatcaagccacaatgaaattcagcatcccgctgggggaaggcaaactttaaactttagaaatcaaacagttttttcatttaagagggagaaactaaagtaaaaatgtcacatctgtcaagaaaaataaagttaaaaaaagtttgaaaagccagtaatttataataattttgaagtctactgaaacataccttgacaacatccagattaaatgtatatcaaatgaagcattctgaaatcaccacacagaaaggttaaaagtttgcttgaggaggaaaaggtgtctttcaaaagcagaaagacagctccaagtgaggaaaagtgggaacaccagagttttgcccaaatcaggttttcttaggaattaattaggtgggctgaaaatacaagttgaggaactgttttttccagaggtcttccaacactgcaaagggagagttagctggagacacagcgaggccctttgatgggcatatgcagaattcagggagaggcaaggagcctgggagccacttcggcagaagcagagcttggacgttggtgatgggagcccagtgaccccagccagcctttctggctgagcgactgcactggcatgaaaccaagatggggttcggctcctgaggtttcctccttcctgcccctgattgcttttcccacctcactgtctttcccctactcccaccagtctgctgtatggggctcctgcccttgcccacttcttacctttccatttgtctccttcccttcatcgacccgaagcatcttcctcatcctccttggagagatggtttgctggttcacgtgtatctctcactccaaaactatggccaaaatcctgtgtaattatttacttagtaaagatatttgttcctgctctctcagtttttatagcagtgatgtgaatcatttctatttcctcactttaaaggaaaatgcttttattattttaaagaaaattaattaaaacttcattttctttaaaggaaattaaaatatctattttcttatttttatttccattctttaaaatgtgctttaggctgggtgcggtggctcacacctataatcccagcactttgggaggccgaggcaggcggatcatgagatcaggagatcgagatcatcctggctaacatggtgaaaccccgtctctactagaaatacaaaaaaaaaaaaaaaattagccaggcatggtggcaggcgcctgtagtcccagctactcgggaggctgaggcaggagaatggtgtgaacctggaggctgagcttgcaatgaggcgagatcgcgccactgcactccagcctgggtgacagagtgacgctctgtctcaaaaaaaaaaaaaaaagtgtgctttaaagtgcatttaaagcaaaactactaaaacgtttacatgtggctcttaatagtttttacctgtgactaggtaaaaattaataggtttcctgataggggaaaatgaccatttttcattcaatataagtcaccattaggcttcttcactggctcttgtgcttcttgtcaaaggaaaagtaaagttagtgactcttcactgcctgttaatataaaataactagtatgaagtgtgattgtagatttacatttaaaggatgtcttcttgaaactttcataccgttttggggtcattggtatccgtaaggtcattttgcctgtaaagcttgattctcgcagacttttggctgattgttccttgtagtcatcacaaatctatgaataaaaccaggaatgggacattgtagcttgtcagtcctcttttcaaaccctgcttaacagtcatattcaaggaattacttattttatgtttataaataggatctgcaaaggacacagcacaacaggattagtagctgtgatttttttttggagacagagtctcactctgtcacccagactggaatgcagtggcgcgatctcggctcactgcaacctccacctcccaggttcaagcgattcttctgcctcagcctcctgagtagctgggattacaggcgtgcaccaccacacccagctaatttttgtatttttagtagagatggggtttcaccatgttggtctggctggtcttgaactcctgatctcgtaatctgccagcctcggcctcccaaagtgctgggattacaggcatgagccactgcgtctggccagtagctatgattttttttttatatcctaaactctttactgtatcatttggttacatatgttgagactctccagtgtgttagagacaaaaaccctgaaaccgccaccattgatacttctatcccttctgatttggggactctcagaagactatacgtccatttttcccctaccttaccaccagtctgattaatgggcagtgattctggcttccctagtatgccttctaggtgtcaaacacacacccaatggcaactttgatttgagaattagaaactgctaagatttgaactcttgattatctgttgtaaaggttctctagtaactattcttaatggaaaatgatacagttctctaaataatttggattatttgacagttaagcattcttcccaaatacctttcactaatctaagtacatttctgtgaccatctgtcatgatcaaattcctctccccacccaccctctagaaacacactcaaaatagtccaagtgcaccgagttaggattttttatgaaaatattctctttaagcctttttctcctttcattctccttcccccaacatagacaaccactctatcgtgtttggtatggattgttttatttgtgtatgttcccataaaacattattggagggttttatgtatttttatgtttttaattattatacatatcatgtatattcatagttttaaaaatggtacagaagaatctacattggaaagtcaaagttgcccaccctgacaatgcccaggtctgctagcacaaatgtcactattgtgtttataggtagtttttcaagtactggatacaaatgtacgtatacttgaaatacatagatattttcatatactctcacatacaatccacattatattaaatgtacttctcttgccttgcattaacctttaaaatttttttaatttaatttaattatagattcaaaggaggttacaaaaacgtactaggaagtcctagtatttactgcaaggaaaccagaggtctcttcacccagtttcccccaatggtaacatcctgcataacctcagaacagtgtcaaaacctggaaatagacgttgatacaatccacagatcttaatcagatttcaccagttttacacacacttgtgtgtatctgtatagttctttgtgcatatattttttaaatgcctaagtggcattgtgctacatgttactgtatttctgccttcactgcttatccacacagttctacatatagctagtttgttgtttcagctcctgaagagaatctagtatgggtctttcacctataacatccttgtttcctagtagtagacatttaaccaacttctaacttcctacctcagtagataatactgcagtgactgtcctcacttatgtcctcttgtggatttgtgtcagaatttcacccagatacatctgcaagagttgggttgctgggacatttgtatatttggctttccagaatgtctgtgtaagtccccatgcccacagccatagcatgaaggtataattgtttaagatataatccttggatttaagaactagaaggtttatatcatggaaaaccattgattggactgtggaagaaaatattaaaaaaaaaaaacctctccgactcataagatattttttaattaaattcaagctacagataatttataattcctgaatggtatactatcttataatttcagatccttttttcacaatctcattctctttccttttcccatctccccaagtagcatttcagaaaacacagattagtaaacacagtttccattgacttatttttgagaagaaggctcttggcaacaatatctaaagttttgaggacatcacttcatttcaggccaggttgatagtcctagaaaatgaaagaaataagggcaagtaataatttggcaaaaaaaaagggtcttgtatagtaaataatcactgtagttgagatttagactaccctcccatcattcatcctgccagttatcatgtgctgtggtcacctacacagctaggaggttggtggctcacctgctgctgtagccagtaactgctcaatgaaaagggaattttaggcaaattgtcacaagactggctggatgtcatagttaggctcctgtgaaataaactgatttgtataaagatacattgctgttctctgtcagtgaactcagttatttgaaagatacgtttgtgattgtatttgtcttactcatttttgaaaacacacagtttgcaaaacatcttatttgcattcaccgaagtaataccttgtgggcaggatagtcaaatggactatttaagtacctattaggtatcagcagctcaccttttttattcagctgagcccccttggtgagatacttgtattatcctggttatgttatttagaatcttataataccttttatgaaatgggtgtaggaaagctatattgactggtctcaggagccagtccatgggacagtattttttaatttagtaaatttagtttccatgtcagcatagaatcatggcacttttgttaattggtttctattgagtactttatttaaatttcttcagtgaaaacatagccttaatttgatttgttaatataaaattatcagctggaggtaactcctaccagatatttaagaaaactaaatttactactaggtgtgctcaaaatcaacaatcagtgggttgtagtgagaaacaagaagctattaagacttgtaaatatgaaaataacccaccacagaaaaaattgtaagtatatgaagtgatggatttgtaacttagcctgatttaatcattttatgttgtaaacttagattaaaacatcacattgtacctcataaatatatacaattactatttgtcaattaaatttaagataaataagaattttaaaacatgaattattgaatggctaagtgttagtacagtatatgtacttcattagcatatagtatggaacaggataacttgggtgccaaggtcagaagttaatctgggaatgagaaatattcctgcagtatggccccacctattgcagtaacagctaccaagctgtgagttgtaagtaagtattcactgctgaccagtgaatctcctgccctttcactttccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtaagagacaatcacacatcattggtgtaactttctccaccttctaaatatctactaggtatttgataaacgtgtgttatttgatttgcacccaaaagtgctttccttagtcacctggagttcatcatctcttttgggcatttctgttgctcaccaaagctaatttttttaaagatgatttggaatagttagtaggaggagaaagcagaggcctgagtaaagattcatcttgaagtacacaaagcgtcgtttattcagagaatgtttatttatgttcatgtctcctgagaacataataggagactgtgggtcttcaaagcagaacaatagacttatagtatctttactgtccctccccatgattcagtttttgccatttccttcagcttcacaagggccatcttgtgagttagccatcccatcctgtgactgtccctttgcttggactctaggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggaggtgaagggcacacttatttgcttttgcattaaatttctgagggagatttaaggaaatcttttcaaagaaggaagtcagtagctgctgttctcccttacaatcagctctatttgtttaacatttatggagggcttcagagtaccacctttagacattcccccaacccccttgcttggcatctctaactggggatttcttcaatgacagagccagcccaaagtagcaattgggctagtaataggacccaaggagccatgcacactgggaggtggggacaaaagggcaaaagaaccttccactaacgctttcttgtgtgggctggattgtagggtgatgcccatgtggacagtactacctacgatggaaccacacccctgcatatagcagctgggagagggtccaccaggctggcagctcttctcaaagcagcaggtaagatggtgatctggcggtcattaatgaaaaatgttaccaggaatgcaaacccaacttcaatagagcagtcatgttgccttctttaagccacagacctactgctgaaaaacaagggtaaataaaaattatatggcaaatcacattttatctgccataaggcactgtttggactagtaatcttgggctttaccctgatagtcattttagtttttactttctgattcatctgtttgtttggggtttgattgtttagattgactcccatgacaaagggtcttttcaaagtagagtttgattccttatagaattctgagtggtattagtctcagatcatatcagaaggccccagaagaaaaagattattggtataagaaatcatttaaagacttcattttgaaagaaatatctcttagaaattgaagtgtaggaaaaagaaaatgggccatgtattaagacccattatgtggaaggcactaaaaatggctagcacttattgacctttctgtgtaccaggcactgtgatatgcactttatgtgcacagtctcatttaatgcccaatcaccccttgtgacaaataccattattccccatcttagagtcaaggaaacagactagagagactaccagatcccacttcagggttccagtaagtgacagagctatgaatcacacttcggcagtgtgaacttcaagactttattctctgtactatgtttctctctcctattttgctcataggtttgcagatgttattccatttaattctctagtcctgtgaagtatagaaaattatccatgctgatctttgaatctccagtgccttgcatatttagaacctcaaaatatgtgtaatgaaattggcatctgaagcctgccctgacatatctgatatactttagaggctttttttttttttaacttaaaaggtaaatgcttcataaattcaagaaaacaaagcaaaagacataggaactttttctttgggacaccatatttttcttttctcttttgttaaatagaactttttcttgaacaagaaactctgattgcagtgggtattaatagttttagaagacactgattaattaaatgccttccaacaagaagctataaccagccagacgtgatggctcacacctgtaaactcagcactttgagaggctgaggtgggagggtcacttgcactaggagtgtgagaccaaccaggttaacattgtaagacctcatctccattaaaaaatttaaaaagtagccaggcatggtggcatgcgcctatagtcgcagctagtttggaggccgaggtagaagtatcacttgagcctgtgagttcaagggtgcagtgagctacagtttcaccactgcactccagcctgagctatagaataagaataagaccctgtctcaaaaaaaaaaaagaaaaagaaagaaactataacccttttaaaaatgctttatattgaattctcagaatcccatgaaaggaaaagcaagtaacagtttctctgatatataaatgaagaaactcagatgaaaaaccaagtcctaatcttaatgtcgtggaaaaggtcagttaagtccgagtgtggtggctcacacctgtaatcccagcactttgggaggccagggtgggtggatcacctgagactggcagttcgagactcacctggccaacatgacgaaaccccatctctactaaaaatacaaaacttagctgggcgtggtggcatgcatctgtaatcccagctactcagaaggctaaggaaggagaataacttgagccctggaggctgaggttgcagtgagctgagactgcgccattgcactccagcctgggcaacagagcaagactccatctcaaaaaaaaaaaaaaaaaaaaaaagcgtcagttaagagatagctcatccctccacactttggtcctgtaaattgttcatcttaatttctccatggattacatttattgcctcatagatcaggccagaactgggagaataaaatcaagaaacagcatgaagatccttctttgtttcccattaagtactcctctattattgatattgacccatctgatgttctcccagcaagataaaaacaagttcctccctcaaaaatggcatcattagacatcaagctaaacactcataaaaatcatctaagcctctgagaagtaactctagctctagtctttgagttactttgatgttttgtttatttgtttgttgtttttgtttttgctggatgctaaagagcagactacatttcccaaaatatttcaataattatacatcctagtaggtttgtttatttaaagatcagaaccctggcattgctgtacccagcaatgaaactggccatgctgtcactagacatcaagcatctttgctcttttgagtgtccaagaaaaggggctgagaaatacacattgtcatgcataaatttgaacagttaggaccctaatcctgagggtgcaccctagtggctgtaatcatgctgtccatcagccctaagattaaagatgcactattcagttgagaaatatcctgtagagttaaatgtgaaagagtatttgaagtctttttttcttcaatagtatctttggctatttcaggtgtcataagacactttaacaatcaaagtaaattacaattttaaaataatttctctggatattccagtagaaatgttttatgatttaaaaattatccaggagattgcctcaagctgctacattgctttgcctttgggaatctgacctttgcaggcagttggaagttgacaagatctgggtttacctaatgctgtgtaatctaacttcgcaggagcagatcccctggtggagaactttgagcctctctatgacctggatgactcttgggaaaatgcaggagaggatgaaggagttgtgcctggaaccacgcctctagatatggccaccagctggcaggtgagtgccgctccatctgtctgatggctgcccctgagggagtcagaggttcaggaatgtaagaacagatggtcttcctggtgctttattccccaaagaacatgccttttatttttaagaaagtctgtttgtcagagaccatttttatcttgaaaaaccctatccatgaaagatctaggtcagctgagttctgagtacgaaagtgtatgcctaatcagatcagagttgagatgtgagaaaaggttagaagaaaaacacaaaattcacataaaagttacccattccaaattcacaccataattgtgaccatctcaatttctgaagctaggataaatgttactgtttgcttaggacttaggtaagtgatttcaggatgtaaaaataaactaagaattcttcttagaatttcaataaatataaacagagtaaatagatttaaagccttcctcaaaactccacagggctgagatctgaaggtataaagcagttactaggtcatttggccccaggaagaaaagccagagggaggaggtgggcagcatgcaagatctccaacatgacaagatcagttcttctagagacgagagctgctccacttctaaaactgctcatgtgcctcccacagcctgtatgtgtccagctcactgacgttagcagagactccatggttctccctttatgttagcacctcatttccccagaaggccttgccacagaacacaaaaagatgatgcactcagtgaccccacgctctccttacccaggtcagccagcaacagagtgactgcagagaacaccacaaatgcctcggcagctacagaataatttttcttttagcctaagacaattctggaccctcagttaaaatgtcagtattgccagagggttaacaccaagccttgtgaacatctagacatctcaatttgagcaagtttatacaattcattctcataagcttgttcctatggaagaagggagacagcttcacagctctgagtaagctcttcactagccttaggtctctgagcaggagatgattgacatggtggcctggactgcctgttccttccaaaaggctatagctctgactctctgcagtttggttgggtattctgacccagctcagagtttgtgcaaagcactatttcccagtaccagagcccctacagctgttcttcccccaaagggtaccatattcttggagggtggtcctgattcctcttgccattcctccatcattaggtaccaggccctcctaaggaggacatgctgagttgtttattataaagaaacagactgccctagtggtcccttcgatgtataacgatttctggtgtttttctttccaacaggtatttgacatattaaatgggaaaccatatgagccagagtttacatctgatgatttactagcacaaggtgggttgtgataaaaccagattctcttaaccattattatctccacactgtcatttaaagggaggaaccagcattatccagggtctactgttaaaagttcttatttcagaaccaaaagatgctggaggtagataaggagaatatccagttttaatctactgtaaatgtatactgccttctactcagctgggctttgaccttcaagtagagtagcttggttggttccactgggagttggacagcaagccaggcagcaatgatcagtccctccagagtgtctatggcatgttagaacaagtgtgttccttcttcatttccttcaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtaacaccttaccttacagatttagcaattttcatttgactttactctgttaacatctctggccagggcataatctccttcccttttccttaactctgaagaagaaaaccagtcattgcccaaggcctgggagggtgacccaggccaagttggcagcccatcttcctgagaatgctgttttcagataccttcagattttccccgttttcaaatacctggagacttcctgtgaaaatgctacgtagagggtcaggattttcacagaactttaacggccctgagcaaacaatcgactgtaatcaacgtgtagcttcctgtccccaagaacacaccttaccccatggcagggcattgagtcatgttctgtgaggtgactcctagtggagccattacccggggatttttttttttcatttctaaaaataaaatgtagaaaagcatggggtgaagttttctgttgaaaatttcatggttagcttttgtttctgcatggatttcagagcttcagcttacagagggagactgtgtagacgtcactgtaggcagagtttcactgcctcagcgcttctctcgctgtctctctctctgcttactacaaaccacttctctgtgatttcctgagtggtctttgagccgaaacaggaaacttgattcgaagactgtattttcttagtcgctcttctctgccctttccatttcctcctggctcctgagtggaggaggcagcatggaagagggaagggtgggctgtcagtgcttacagcctgcactgggactcgaacacaagaacatgctcctccttcctttctttctcacaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaataggtaaaaaaaaagacaaaagacagtggagatattttccagctcccccaggctggtgtcttcagctctttttggatatggtgtggcagttttctttctcgttttctggatacacttccctgtgtgtctctctaccccctgggctcaccctctgcctctcttgatagtaccattcagatgagggggtcgtacccttggaaaatcacattgacacatgaactacttagtaaacactaaataatacaataaatactaaaaacaacatgatgtgggtgattaaatttaacacatgagagaaataatatttaccttaaagagagaaccatctccttcttcctttgcctcctctctcaagcttatgacactgaccttgtcccccaccatatatgggactacgtgtcatgccaccaaaagtctcgcaaccatatgaaatggactctcaacccagcccagtaatcctatatttcctacaattttattctcccactctgtaaatgatgattccatgctttctatttctaaacccccaacactccttccctccccttactcatgcaacacccttgcttcacactctgttgaaaacagaagaaaccagaaccctctcacctttgcaccaagtgccagcccacctgtgcctgtgcccacattggcagccttccatccggacttggtgggttaaatttctttgcccagctgaggagccacctctcccctgagtctaaccccctcacctttactaggttgttgttcctgttaattcttacctctctctcctgtactagccgttcctcctccccactctccgactaggtcacctagcaagcatttcatgatttcctcatctttaaaaacaaaacacaccgaaacaatcaccctcttgatcccacatcccatttagctacagtccaattgctctattcccatacatagcagagctccttcaaagaattttttagagttattctttccagcttgccaccttccaccctctgcttggcctcctgcagttgggatcgcatccccaccgctccaccaggcctgctgtcctcacagtgaccggtcacctccacattgccagatctggtcacctccttttcaccttgaccacttgcagagtgtgtcatggttgacgcctaccttcaacttcagaccgtctccattcctggctcctccacagcacactcccctggctggctcttctacactcaccttttaaagtcacagccctccagggtcagtcctaaaccctccctgcttggtacctcacccaagcccaatactggctacatctgtcagaagcgctgccatcttccaggagattaagacaaaacccaagaattcctcaggagtcctttctgccactaatcacttcgtatgcgacgcatcgagtgtcatcctgtctgcaaccaccgccccaggccagcctgccgtcatttcctgcccaaattcttgcacggctcctactcagtccccttgtttccttcctgtccacctcccttcagtccattctctgcccaacagatggtatgattcttctaaaaaatcagtgacattgtattaattctgggttatgcccttcagttcattcagtcattcattcagcaaatcctgatccagcatacactgtgtgcctagcagtgttcgaggttttaaagataaaactgtgtccctgctttactcgtttgctttcttaaacattgctgtggaagctcttcctccacactgcgcctccattcccaagtgttttctctgctcccctggctcactagtctgaccaaccttttgactgtttcttcccattccctggaaagctcttaattggctggctctttcttgccactcagtttcagcacccatctcaccctgccagggggccttcccaggggagcaagggcagacgtcattgtccgcacttgagaaaggaataatgtatccgccggaaaacaacccagatctcctgagtcacagcccagtgctccttctgcacagatattaaaaaagaaaaaaagcaaatacttaacatttttttaaaaagtaaatacctaagcattaagcccttaatttgtagttatttttaggatatcgcatagtttgtaacccataatagacaccaaataaagattggttgattaaacaaatcagtcaataccaaaatgatagtcgtgccactggcattaaagtcttaatattctaatattggaatttggtacataagaagatagcattttgattagtgtatgttagacttctgtttccttcctcactgtataggaaataatttgtcttggtcatatccctaaggacacttataaacaaagggaattcaacctgattttccagtatagactcattttcaccaaaatcattttacttttattgctaccaaaaatgttttcaaggcaatgtatgctgtaatagcatatgaggcccagagagagatctcatttttagttcttgcttctgtcaccaatttattttgctgaggttcagcagtttccccagctatgaaatagataatacagtggttggaaaactacacttgatttctaagggaaaaaaaggtccactgtgagtcaagagaattcagaaaggattctcataaacacaagactagattgcaggaagatgtgaaagcatttggctaattctgacatttggctaataacatcctcacagtatgtcccaagtatcttctgcccttcccaccacggtgagcagtcatgacagtgagggtggcataggtgggatgtgtggctggcagaagccagtgggcaagagttgtccacagaatagtccatgagctttttagagcccggccattcccccagtgaatttgtgctttctcccctcagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctcaccttgtttgatctgtgcaaatacttttctaagatgcttccttataatcatgggatcattccgtatagcctggttatcacattcacattgcctattagagtcaattttttaatctagaaatgaacaaataattatcaaaaggaaagtgttttaacctaagatgaaagctttggatttgcctaatccttacccagctcatcttatttagattgtgccacctcactttcctccatctcatgcaatgctacacctcttcaatgtcttctccacacctctgtgataaagtattaagatttccatataccagagggccctggactaggagccttccagcatgaagctttgctgaacaacaggtgctggagaggatgtggagaaacaggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatgctatgcagccataaaaaatgatgagttcatgtcctttgtagggacatggatgaaattggaaatcattctcagtaaactatcgcaagaacaaaaaaccaaacaccgcatattctcactcataggtgggaattgaacaatgagctcacatggacacaggaaggggaatatcacactctggggactgttgtggggtggggggggaggggggagggatagcatcgggagatatacctaatgctagatgacgagttggtgggtgcagcgcaccagcatagcacatgtatacgtatgtaactaacctgcacaatgtgcacatgtaccctaaaacttaaagtataataaaaaaaaaagttgggaatatggaagaggaaaaaaaatcagtttttgagcgaggtactattgtcgacattgtgatgcacaaccaggattcccctttgacaaaggactattctgctggtggtgcactctagctgtcagctttctcatggaatgctgccgggagctgtgtcttcctaggccacatccatttccacaatggcacccatgcaacattgatcaatgtggacatatgaataagcctgtccaaccagggacaacactgaagggctgttgaagcttcagggttcccattagagaggctgaggctgcattgcactcaacttctccctctgcccatcctgcttactctctcacccttccatagctgttgagcttgaaggcactccagaaaaacatttaacataaatttccaactcagagtcagtctccccgagaaccttgcctgcacaaggtgcttggaaccatgcagaacaattttgcgcaacacattgagccattaatcttgaaaaacaacccaacttataaagaaggaaattgaggcttaaagtagaccatagctaagctgcttctgagtttacacccagctctgtctagctccagagctcatgatgggatattatcctgatgagaaggcagataaaaatcatttgagtccagaagtaggctccaaaatatataggaatttagtatatgatacagtaaaatttcaaatcaatgagaaaaagatgattactcaatgtattagtctgataaatgctgataaagacatacccgagactgggtaatttataaagaaaaagaggttcaatagactcacaattcgacgtgtttggggaggtctcacaatcacggcggaaggtgaaagacacatcttacatggcatcaggcaaaaagaaaatgagagacaagcgaaaggggtttccccttacaaaaccatcagatctcatgagacttactactacgagaacagtatggaggaaactgccctcatgattcaattatctcccaccaggtccctcccacaacacgtgggaattgtggaagctataattcaagatgagatttgagtggggacacagccaaaccatatcactcaatcaacagaggtcccaaccggctaatcacttaaaaacaatccatctgaacacctgcctccctcctttcatcaaaataatttccaaatatatcaaaaattaagccataaaaatattagaagtactagacgtcattgattgataaataatcttgatatagggaaggcttttctaagcaaaacttttcactggtataaaagcagtttaggttcttcattttacagcacctcccaaataaatagaatctcaaggagaatcctacttatgttttctattacattgccatttctccacccctacccagcccctacccagccccactgtaaagtgaaaaaatacagctctgattttcctcaattcttaattttccaacaagcagcccatgcctccacacctctgcgggttcctttctgtggcagatcattgttttccagctggccactacaaagcctcctgacctacaacatgaggctgacactcctcccactgaggggaggggcctgggttccttctctgagaatctaagcaaaagtgacaaggacggaggagatgctaagtgacttccaaggttaagtcataaaatggaatacaacttctacccccatcgtgctgtgccctctgtcttagaagctggtcattgtgttctgagggagccaagtggccacatggaggaaccaagtgcaggtgttcagtccacagacttactgaggccctggctgatgccagcatcaaccaagagatgtgtaagggagtgaagctttcagaagattccagccctcagccattgagtcaccccatctagccctcaaactgcctcagctgatgccaccatcaaccaagagatgtgtaagggagtgaagctttcagaagattccagccctcagccattgagtcaccccatctagccctcaaactgcctcagctgatgccaccatcaaccaagagatgtgtaagggagtgaagctttcagaagattccagccctcagccattgagtcaccccatctagccctcaaactgcctcagctgatgctgcccagaatagagacaagctgttctgcagagccctgcccacattgcagattcgtgagcaaattaaataatggttgaggttttaagccttaagtgtggagtggattgtcaccatgctccaggcttccaacttgacagctcacctaccagaagttcacttgaagtgaagctgacttgaggaggaggaacaactaagcaactcatgccaagatagaaaaatcacattccccttctttcataagaagccccatttctcttctgtcccaaaaacttactcttcctcccagatctcagtgctggcctgaacctctgtgtggtgctgcaacagcaaggccaccagtgctgtctgggtctctgtgaaagtatctttcatattgtaccagcagatggagataaaccaaaaggaatgcaggagatcaggtggaaagctataatgggcctgaaataaaccttcccagaaagcttgtgtcacagcaggaggccatttaaaaatagcttcctcagaacttcagtcatttttgaggtttctatactctgcaggcataacccagactttttcaggatcagcggtctttcttttcagcagaacgaagccctgctgctgctcatttacctatctgcgtcttctgaagtagctgaatgtggcacagacgttcctggtcaccactatggaatgcagctgcacaaactggactttgtacattttaacaggaaaaaaggaggaggggaaagatccagccagcatggagcatttattacatgccagcccttttggattaataatttctaatgataattctcaagacacccctattaggtatatatttaaccccagtttataaaaaggaaatgaatgatctgaagttattaaataactcgccccagattcaaatgccggcccatctgattccaaagactattctttagtgaggtttgcagtcctttgacaaaaacatgctttatttaaaagagaaagaaaaatgcatacagtcctgtacaaagatgatggagtcgtcacgtacccaaccaaaatgcaaaatgaacccaaagtataactaagaggacatattgcttggagacttgattttccccctaataaaaggcaaggatgccttaaatatgaattattcattgactggaagttattgcatttctttcagcctcctattttgtgcttttgggggaaattctgtttctgacttgtgcttccccagggaatggacatgggaggcacaggagtcaaaagaggatgaaactaaaattctgtttattttcttgaagatcacagaacttggggttggttaagatcttaaagatcaccttcctaaactatccaagtttttctgaatgcctacaaagtgagagtgtctcttctccattggcctcactgtggctggctgcttcatgtaaataccaatcctagagactacaagttcctgtccattggttttccaggtttgtcatttggttttggaattgggggagacactgaggagaggcttgaaattaaatggatctccttcaattaccatggatttcattatgtccacaatagcctttttctgttaccctggacaaatgaatagttccacaagttgttcaagcttcttaagatgaaagggaggaaggggctgagatagcatcatcttacttctgtcaactagcttttccacgttgatacctctttccaaagtgattatttcattgaactatcacaagagtcttcaaagaataaagatatgtgttcaatcaagatttcttgggcatctgttgcttgccaggcactacaatgggtggtcatggggaaactgagacacatgagaggcatgactgcaggatcacttgactccagtaacaacactgcagcagggtcaggggtgagtagtgtctctcttccacttagccacacatggatccaggctgacagtcattcttcctccaacgcttggctcctaaggtcttgctaggggcgatagccccagtcagccaggagaaaaatgttgagagaagtatgtgagggagttttgaatgtgtcacctcctctcatgttgtgctggagaaaaacttcagtcccttggtcacactaagagcagtgaagatagaagggtggtctacttctgttcccagtattaagagagctgttgattttggaacaggtcacagcctttggcacaggtaataatcccttcactgagggaggctgagccataaggttctttctagttgcaacttgtatgcagatattcactctgaaagtcacctgcaatcatggtaaatggccatcactaaaggcaagatcatttcgtaggattaagcatgaagattgcattgtaagcacaaagtcacagtttttcttaaggaaatcctcagagatgatcaaggatatgagggcaggtaggctggggaagaggtatagcagctatatcttgttgccctcgcactgattcacagagatctctgctctccaacctctatgctccgtagttccttaaacgctgcacaagaagtcctgggcttgtagacaccacagttagcgttcaagaggccctggccctttaagatcctacccaaaagaaagggacaagcaagtttatcttagttgtgttctgcagaaagctggaaagaccttggctcccattttctcagataaattggaaaggagcagaaattggttcttgtggaaataatattctcttcaggccagaaggatagcagatgaaacaaattcttgaaaacttttctcccaggattccttcttgggatccaggaagcagagctggtgatgaagatagtgagatggaaccctgaggactatgttggggacacatcagatcagggaaggctgtaagtcgatgcccagtagcagacaaccaggttactaggtctgttccctggcgaaaagagatcgatattttcttcatttcaaaactgtttcgcagttccctttttccttttcctaaagcaataatgcacaacttattttttggctttaaaaaattgaatgaaaaacttcatgtcgtgggttttttttttttttacatttccagcatccctttttatcaccttattcaaatgcaaatgttcaaaagtcttttgaaataatttttttctgtaattttgaaaaaaattcgcaaaataaaaaactttaaatgtaaatgttttcatttagaaaatattttcaagtactgactgtcatagcagcctgagaggtgaacagggaggggtttgaattcctgccattgtccacaggacagagttgctgatgtgctggaaggcccctggtctaatgtaaagagcaaaggctgggccgggactcagtcttcaatccccatactgtgctccttggcttcacgctgcagcagtgcgtcacggaacacacaactgtttcaaaggggtgggtcatgcccaggaaagggaagaagcttgccaacagggggctctgaagtattatccaagggtggccaaacagcaggaagccagcattccctcaacaaatgaactcagctccagcacacatgatgcttggcaccggtccccaagaacaggcccaggaagaggccttgagtccatgctgactttcttcctcctacccactccttccagccccactccttttgctttggggccctcagaagctttttttctccaccacttgcttctttctgccacttctttgtgtcccttcaccttccctcaacaattcaagccaggacccccaaaaagctatccatgggccacccacattaatgcagaatcctgcctcccagctgaagcaaagcctggcctagggaggccaaagggatcagaaatgacatccccgtaaagacccatcgtaatcccacagacaggtcctgctacaggagcagggctgccaaaaagcaacattcttgttctcttcctttaggtcctgaagctcctgcccctccaccactgctgccagcgaccacagtagcagggggaattttacctccccagtatatggagaccatatatgctcaggaagtgcatatatgctcacagatgagcaaacctctcaggcctgattgatgcaagcagtccttagcattcttctccatcccagttttgatctgggaaggtcaaagccaccatttggccccgccttcctttactgcctagccaaatgcacatcttgaatgatgagcaacatatgcacacagcgtgtgggccaaggacgattttggtccctccaccagcagaatgtaattcctttccccaaatcacgcccatagctcacagttttggccctttcctgattgttttgttactaagcctttaaatagctcatctgacttctcctctgtcaatcatctattcaggaggcttggtaccaagttttcatagatccatagtaagtaaatttgaattaaaaagcatttatatgccacacttttgccaaggtagcaacagtggatggaaatgaaatacacatgcttctccacttacaatggggttatgtcctgataaacccattataagtcaaaagtgcacttaataccttgataaacccatcataaagtcaaaaagtcataaaatcgtaagtcaaaccattgttaagtctgggacctgtctgtaaccaaaagacaggcagaaagtagacaaatttgctctgtggatctgaaccttgtgatccagctatgctggtgctcagcctttattagccctggatccatggaagaaaccagagctcagcaaacagagacgccctttgggttccttctttctccttccacccttcctcctcacctccctccttcctctttctccctttctctctccctgtgtctatctcttctctctcctttcctttctctccttttctcattgtcttcctttctctcccttctacttttctctctcccctccgctttctctttctctcttttctctctctcttcctttctctttctctctcaccatttctttccttttctctctcattcttcttctctcccttcctttttcctttctctttctctcctagtctctttctctcaactcttctctttctctttctttttctctttctctttttctctttctcccacctctttcccccttcatccctcccttcttttctttctctttatttccttctttaaggtactttcacattcatgcattcctctggggcactggcatccaactccctgaagcccagaaggtgaggggtttggggagcagccctgcaagtgtttccttaggctcccctcgcctcgctgaaggcagcaaatgccctgtactctggggaagcctccaggaagccagcaccctggcccagggcagtcccttctgcacaccactagcctcatttcctgagcacaagaggcctctgctggaagaagcagaactttgcacaatcatccaacagctggcttgcctattgctactcaattttattttattttattttattttattttattttattttattttattttattttattgcttctgtaaaattggaaaaaccttaccaaaaaaaaggaattagaaatttcttcagctttctgcctggatttttctccttcaactcagttcatgaagcctgttgattattttccctcagtacagaaggcttaagttgctctttccttttagcaagcggaatcaaagattcttaggcctgaacacttcagccaccaccagccttatcctttgagggatgatattgataaaccaacatttattgcatttactacatttatatctttattttatttaatcctcacaggaacactgtgagatagttattaccattaatctcaacttcaagataaggaaactgaggcttagaggttaagtgattggtccaaggccagtaccgggaggttcagtatcagagcatgagcccatagcccttgcaccacatgcagtcttcacacttacacacgcacgtgcatgcacacacaatttggatctttgacaaggcaaaatttcattcatgtttgtaagttgactagttaaaaatcttttcattccaataccaaaaatatgggtagggaagcatgccagtcacccactttggcttgagagctcattgtaaaagagcaggggcccttccttcacccactttggcaattttttttttttttttgagatggagtctcgctctgtcgcccaggctggagtgcagtggcgccatctcggctcattgcaagctccgcctcccgggttcacgccattctcctgcctcagcctcccgagtagctgggactacaggagcccgccaccacgcacggctaattttttgtatttttagtagagacgaggtttcaccctgttagccaggatggtctcgatctcctgacctgatgatccacccgcctcggcctcccaaagtgcagggattacaggcgtgagtcaccgctcccagcccacttcagcaaattatgtccccaacagccttcctcactagaggcaccactgccactgcagcatcccagcacaaggaagtaggtgacgcatctcccaacaggacacccaggtgcccacactgccctctccaaggcccagatatgtttgacctcaaagacccatgtctttatccacgaggatgcttttaatgataaaatgagaatgcctgactataagtgggctaaacaaataagggctttaaaaaataccattacaagatcagcgatagatacatcgatattttacatggaatctttccctttttaaatgttagcatgtaattcaactttttaaaacacagtctagaccatgacctgctggtcaaatatgacctaaatcttcaggatgacaaggcagggtgcggggggatccaggtcctacctgctcctctcccaggctcactgctgcccccgacacctccagctctcctgtctgatgctgttcacagccaccacccaatgcctgcacacgttcagttctgcccacctccctagatttcttctgatggcttcacacagaggcaatgatgattgtaatagctcacatttggtggatagttatcatgtgctatcaataatctgtgcattatctcctttatacctcacaattaacctatgaagcagatactgttgttattgttcccatgtttaaagaaactaaggcacagaaagactcagtagcctgtatccaatgaagaacagcctgctactggtggatctgggactgaaacacaagtaagtccgatttcaacgcccacacctttaactgctgtatcaattaggatgctttgggttgtaaaatcagaacacctgactacaagattaaacaattaagcctttattttttaccacattataataagaccacagttagatggttgcagggttaatttagcagctaaacatctctgacaccccctgtcaaatatgtttctttaagatcaccaaaaaaaggctgcagcagctccaagtgtcaggccctcaaatagcttctcaattttacccaacagcagagggttttgcctcaggtctatcccttatcaggcagggaaaccttcccccagaaaccccacattagacatcaacttatgattcattcttgaaatgtgtcatgggcctaaccctacatcaatcactggcaatggagactaggattagaataacaaattatgattcagtctctgaggctggacatggccacctctattagcagagaggaggaagatctggctgtgaggtggccagccaacactgtctgctccaactactggcagtggtccaataaattttacaaaaccaacaaaaagtaacaggaacagaatcagaacaagggggttgttcccacctaaattatgaggcagggatgagtgctagttctcaaacagaaattttcgtgagccagaatgtctcatttcctgagagttgtaggtaacttaggtgttactataatcatgtgtacttgatcactgcatagcatgatgtggcacacaggggagctcaataaatcttgtttaaagacagagaccaacctaaggggttaagcaaacttttctttcatggcaggattcagtaacccgtgtctacagaaataaggagagatatttataaggagagatatttataaaacacgaaacagtgatgcattggtcttatctttgctaagttcattcactgtttggccccacacaaggacttaaagatgtcttggcaggttagttcacccccagcttgtagatcacaggctcagagccccaactacataaccagctgattttgtgcttttctttccttatgtattaattacaatgaaggtctttaaagactcatttctcaactgaaattttttcacttattttttaccatatactttccaaaaagcttccctgaagtattgaacaagatggtgccttatctaacattgctcccctgtcgccatcacattaaccttaaggacttatcgccagctggaattgcctcgttcgctggtttaatgatccatgagaactaggacttgtctgcctttttcattgccatacccccagtgacaaggacaatacctgcccagagtggtctgcagtacatgcttgataaatgaatgaataaatccttaagttaaacagtgtctaggggcagaatataaacatgtcttaagacaacaccggttttgccagtgattttaaggttttgtatgctactctggttcatgcctctgataaatcaattagaaaacaagaattctcccattcacttgaaaatattactgtcttttctgcataacccttttaattgcatgtgcttattgaattaataagattgcattcagtcaaggcagactctggggatgttttcaaatgctttgaatttcccacacagacaatgcctacctgcttttctccctaaatcttaccaagctggggaataagtttcatatctgagagccagaggtagcccaagagaatattctttctatctcaggtctttgtcactttaggaatgttagggaaacatatctttatttctcctgcactccagttcaccttcattccaacagagaacaaaatctttctatttattttccaagtgacttctcatggtgtgaaaatgtctcacaatgaaaagtgaagtaaggaaaaaaagagaataagaagagttatcgtgaatgtgaatgagaaaattatgatttttattgttctctctgttctgaaatgggaagatataatcctgggaactgacctctcttcatcccactctctctggaatgtgctttgcaagagcatatgacagtaagacctggttctggtctttttatcctattgttcacacaactaaggatatggtttagatatatgtccccatccaaatgtcatgttgaaacgtaatctccaatgttgaaagcggggcctggtggaaggtgtccggatcataggcacggatccccttggtgataaatgagctcttgctctgagttcacaggcgatctggtggtttaaaagtgtgcggcacctcccacccactctctctcgcttgctcctgctttcgccatatgacatgcttgtcgctgcttcgccttctgccctgactgtaaactttctaaggcttcatcagaagccaagcagatgcccggtgcgatgcttcctgtacaacctgcagaactgtgagccaattaaaccgcttttccttataaattacccagtctcaggtacagcaatgcaagaatggacaaatacaaccactaacagaaaaaccctatcagaaactcaaagtcaagagtaagtgcatcagactgtattcctgcatggcaagataaatctatgaaaacagtaaaaatgactaactgtgctgccacacaagaactgcggaagaatgttttggctactattattccttaataggaataatatgtatacggcacatttcttttcttttagaagttgttgtcagcatatatttatgtcctttaatttattcttcccttacaaattattcttttctggtattattttcagaaagaatttgctgaagaacttacttaccatttgcctctcttcacttcatttttactattgctttctgtactaactggatgataatgaatgtgatgttaaaagtacaatcaccatttacttagcattttaatttgttccagaccctatttgttaagtcctcacacctacctttgaaggtgagggatcattagctccattttacagaggtggaaaccacagttcaaaaggttgaattgttgcccaaggacacacagtcagaagcttcagtacctggatttgaatctagagactgcggctggaagcctcaccctctccaggacaccgagctcaggcccaggatgatgcttccattacagagcgtcactatgtgccaatctggggcccagcccttgagctaaattattttatttattcttcaaaacaaacttacaaggtgggtgttaccactcccatttagccacaagaaaactgagcacaggaagttaagtaacttgattaaggttacagaactagtaagggcaaactacaaagtaaactctggctcatcagcttgaaagccccttctcagggcccctggcagaacatgcacaggtgtcaagaagagcagtcctccctgcctcgcagcaatgctttgctaaaacaggatttacaatagtcataagaacatgacataatatttaccaagtaagactctacggagtcccagccctaagtccccttatccccttgataaggctttgtgtgtgtgtgtgtgtgtgtgtgtgtgtgtgtgtgtgtgtgtgtgtacatataaaatgaggatactcttagatactgaagaagactggattgtctgtagttacttttagagtcactgaacataatgcttctcatttttaaaaccaaaaccactaataatatcttaattttaaagccaaacactctttgctggtccattctataaccaattacatgactgtttccagagaaaacctttcacatgtcttagtttagattcttcaaactctcccagtttaccaagcagaataataacgagaactaaatggaaattagggtccagcacagtattgggcaaaattgaatatttatagaacggttaaataagccacagatgaaatatcaagttgtcaatgtaatttatataacttttatttttatataatttcacatgtacagaaaaatacccatatacctttacccaaatagctaccaccaagaaatctctgttgtaacatttcaatcgccattccctctgaaataataacaaagcactttatttgagtattccgtattccccaaagctagctgtgaaagacctacatcacctcaaaaccttccatttggttccatagatcctgccatgtcacattcttgtaaccagctgcagggccatcttgttataactggttcatgtcctgctaaagctgagaggtgaagggctaaaaacacagtcctggcacagattccaggacaccccggcacaggcttgtttgaggacattgcctgggtaaacagcctcccctgaaagtgttcagtgtacaactcttcacagagcaatcgctcaaatgcgtggcagcacgcagacatgtctctcggcttctctccttgtctctgttgccttcctctccagtcggtgctttagaaatgctttattcccattgtccactgaaaatacaacctagattccttcagtaaatatctgttaaggaggtcacatgaaaagattgctccaactcattcttgctggtgggctcccaagggtaaaataatatagttcgtgtcttctcagtcatgaggaaaccattgtcactaaatctccctgggatgcttcctacatccaaccaaacaaagggagcgacagctgaggtctccaggtcaaaaacaaatatgtcaccttgctgagagatgatggcctgaaaaagaaaaaaaaaaatgaatgaagtgaaggatgagggaagagttatatagtctgtatacagttcctgtaaacatttatgtgggcttaacaaggagtccacttcccacaactttggttctacaactgctaaagtgcagtttcaaacacaaaacaatacatggaaaatgactacaggctatggaacgttaccaaattataatcacaaatcaaggaaatacatcgtctccaatcattaaggagaatatttcacaagaagctcaaagctttacatcttttacagtttttctcagagtatcatcaagagagcaacatttttacatacagcctgggtggttttaatgactttctaaggatatatctggacctagctacagagcccaactgtggagcttacattcaagtctcctgaaaagatccagcaatctagaaagtccactgccagaaatttacaaaagctctaccattagagcttatctcttttactgcatagttaagtaaagtcacattattagcattttttttacatgtgtgaattccacaaaatagcagcaaaaagagacagtgcaatttaaatcgtgttggctccattcctcttaagtagccgaatagcatatgcccagagtgaggatgcgctgctccccagagtgggagggtttgcaaacctctctttgtgtgagcacggagctgagtgcaacctggtttcttaatctgtgcatttgtcatgcaacatctcagtcttacattatatgttatgtgtgacataaagaatttcaaagggccattttcactatatataatttagccttacatatttgtgtaatatgttatcattcagggttctgagttatacacaaggaaacctatattgatagaagcagaaaagaagcttaataaagcgtatcaggttgctcttcaggatcagagactcaggcttgaatttggatggcaaattcccagatcgcaccgcccagctgttccagtgaaggtcctaaagcagccacaggaacaaggttcatgcggctcatgccagcctgcccaggaagctgccagggtagcatcagcttctgctgctccaagaccaaggccgaaagagatgctggtgtcatgcttatgctggttatcttcgttggattggaaatctcctctctgtatgtctgactgcagagcctgggattcaagcttgcaccctggcttcagggagacagggagaacaagtttctggcatctcccttgagaaaagaagccaaatacctagtctatattagccccgaattaaacattaactaacagtattattactatcattttatctctttaagaaggacaagtctcactgaaatcaaaatgagatagaacaaagaaagagccctgcttttctcccaccccaattacccacctcaaggtaatgaaggcctaactcaggaaagaaaaaaatttggttttcaaaatcataagtttagagactgaaaattcatccagtacatagtggttttttttttcttttttggaaaaaaatatatgtaagactgtcattttcttctgttctctattagttgttacagataacttggattttattatgtgactatagaaagaaggtatgttttcagttgttaggctctttcaaataaaacacaagaattaggtgtttttatatgattatttctaaattaaatgtagaaaatccctttctatgaagtaaaagtgtaaaacaaatttaaaattttctaaaaacagagaatgtaactttctagaaagatatttcctgagtgtccagaagataagataataaaattaaaaacatatatgtgtacatatatttccaactgctatgtgtaggggagaaggaaggaaaggttttcaacctactagacaaattccaaattctccagctgcacaatttttataacaacacatcctgatcatcccatttttatatcttggcaattataaaaagatttggtgattgagctactttgaagcaataaatcaaagagactagagtgaatattaatagactctacttaaaattagactgcgtcagctgggctccaatgcttcccagctacaggacctcgagctcatcacttaacctcctaaactggcttccaaacttacaaaatgcagatgataatgcctggagctgtggtgaaagtcagagactatgaggtgaagcacctagaacacagcctggaacctagtgggcatgcaggcagtggtgatgactcgagcttcctctcccatcactgcacctgcccactaaggaggggtgatgggacaaacgagtagtggtcaccagcaactctgacaaatcctggattcgaaatagaaatcatttggtgtttgcttttagtgggaagaggccaatcttcccccaggcctcaggtaaactcagcaccaagggggacacatgcaaatctcaggatgcaaggagctggcccaagagcaggagaaccccacaaggccacagtcccctgccctccgccatgacctgtgcttacagtgatctgcgccttgcagagccccacggcctccttcggtgaggacaagaagtggtagttggtcgggctcaggagttcatggtcagctgaaaggtaaaaggaaaccacacagctttcccgtgtgcaattcccacatctcctcagcaattcagacactggctcctcataaaggcagacagcctctcctcctttcatcacaaaacgttcagtcacacgagagcacacgggctccagggagctccatgtatggactctcacctggggagaaataaaacagaataaaaacaggcattcttggttgctatgtttttaaggaacaatagtagtaataattgctgaaagtcaggttagcagaaatggttaagagactatgaaacctgagttttaatcccagtcctgcaaaatactagctatgtgactaagtaacttctcagtcttcatttcttcatatgtagaatgaaaataacagcagtaatgtcacaggctgttgtgagaatttaaaaaataatccacggaaggcacagtacctggtgcgttgtaatttttctgtaaatgtgacctattttcagtgttattagtgtcctccaaactatagccacctaagactttgagtttctagcctttctttttacttaaatttgttttttaaaacaaatttgctttccacatgcgcattctgaatagttttactgattttcactataacatgccatttttaaccatttctttttataaagtttggactatttccagcctctcacaattataaataaccttgcatttaaggggcacattatagcatatgtgatttgctttcatctagttattttatttcctactcatagaaatcctgtaagaagagagactggtatcattttactgagaagaaattgaatcaacaagatgtgaagggttttgcttatggtcacatgattaatggcagggttgtagcctgaatatatgtattctaactctaaattaatttctcttttattttcccaaaagaatgtaaccaaacaactaaagaaatcatctaaaagtctccttcgatcttagaaaacaatccaagtaacttacactgagtgtcatcgaataatccgagtgaagatctgacacaccatagatatagaacgtgttttcattctcaaagcctactggcaacagtggagcaaagaaattctgagcaaagtaatgaagcattttccactttcctccgtactctgaaaataatcaagagtgtcaggagacggcaaggtcaagtagtcagagaggcactgtccaatggcccagctgtttgtggctcatcggggttctaagggagtgagcatgtgagggagagtcaacagtggagggcacccatgtttgtgaagcgctctgagcactctggacattatgtcatgtcaccctcacaacatctgggcaggcactaacgaaccagggcaggcattaacgaaccatgctgttaggcaatttcatcattgtgtgatcatagagtgtacttaaacaaaccaagatggtatagcctactacacacctagactatatggtatagcctgttgctccaggctactaacctgtacagcatattgctgtgctgaatactgtaggtaattctaatcatagaaatgggacagtgaaaatacagtattataatctcatgggaccaccatcatatatgaactgtgttgttgactgaaatgttatacggtgcatgactgtatataataacttatagattctaggtagctattgattgctttaatatataaccatttcgggtgataagagataacaaatacctcccctactgcacgcactagaagcagtggatttattgagccaatcaacatggggctgtgaggcccccagagcagaagcagatatagaaaacttgtcacagcttctcccggataacctttttgtctaataagtacaaggagctggtgatcctcctcaggcaggcaggatcctgccagggtttagaaaacagccaagctctggtacttgggttttcctactgtaatattattatatatacatatataatttttcttctacagttagatatggtttggctgtgcccctacccaaatctcatcttgaattgtagctcccacaattcccatgtgttgtaggagggacctggtaggaggtaactgaaccatgggggcaggtctttcctatgctgttcttgtgatagtgaataagtctcacgagatctgatcgttttataaagaaggagtttcctgcacaagtcctctcttacccactgccatgtaagaagtccctttgctcttccttcgtcttctgccatgattgtgaggtcttcccagccatgtggaactgtgagtccattaaacctctttttctttacaaattaccagtctcaggtatgtcttcatcagcagcatgagaacagactaatacaggttcctagctcacaactaccatagcccttgttacagactcttgttataatgttgagaagctttaggactcaaaagcaggcctcagaaaacagaatctatctctctgatctccttccctcctttcaccagcccaaggcaggtctctaatccgattgtgggtcataagacactcattcagaaggtgtcctgcctcataccctggaggaggaaatgcttcacagagaggccaagaagctgaatggacaggccttgctgtgtttccccactcagtctaatggtattagatcatacccgctttgtccaatcacatttctacatggttatcaatcatggctgtccaatgaagtctccctataacgcccaagaggacagagttcaaagaacttccacatagctgaccatgtgaaggctgacagaaagaggaacaagtattcatctacatgcctggagggtggcacaccccagcctcacagggataaagttcctgcactcaggacccttccagacttcaccccatatatctcttcatacggctgtttatttgtgtcttttaaaacatcctctgtaatacagcagttagaatgtttccttgagttctgtgagccattccagcaaattaaacccaaagaaggggtcatgggaaccccagcttgaagctggtcagtcagaagttctagaggcccagacttgcgactgctgtctaaagagggaaggcagctttgtggaactgagttctcaacctatggaatctgatgcaatctgcaggtagatagtgtcagacttaaattggagggcactcgcatggtgtccactgcagaagtgattgcttgcttggtgtgtgggggaagtttcccatatatttggtcacagaagtcttctgtgtggattgttgttgtggagtgagggaattaacaaagcacttttaggccaggtgcggtggctcatgcctgtaatcccaacactttgggaagctgaggagggtagactgcttcagaccaggtgttcaagaccagcctgggcaacatggcaaaaccctgtctccagaaaaaaaatacaaaaatgagccaggcatggtggtatgcagctatagacccaggtactcaggaagttgaggtgggaggaaggcttgagcctgtggggtggaggctacagtgagccatgattgcaccactgcactccagcctgggcaaaagcagagtgagaccatctcaacaaaaaaacaaaacaaaacaaaaaaccacttagagtttgagtgtcttgtttcccacagacctactcttcctgaggaactcaggaataatctgcatgggatcacttaaaggaatatttacaaaaattgggctctcccatttcttgaatcgaactcagtttcagtccacaacctcatccacagacagaaagcaggatcagtatccaagagtctctgaacagttatctctttgcctacctttccagcatcccagaaggattttccccccaattctacccctgattctcattcaatgctctcttatctggttggtgctgataaagagtttggtcagagaaatttgattagaaatccaattctctgtaagagtcatccatctggcactaatgaaaacatgtttggaatgaatttcttttgatctgcattcacagccagtttaagagcctcacccctgcactctagcctgggtgtcagaacaagactctgtctcaaaaaaaacaaaaagaacctcacccaacctttctactttgtggccttgcctcgtttttgaccccaaactattctttacattattaactgaactttgtttcaagtcatctctagtgaagggcaaagactattattccttaattttttttaatgtaccagaatagatgggataattcgaactgcaggttccatgccagtcatctcacctgttgctagttgaactgtttcaactggtcacctttcccattcgggattctgcctctactagcttttccccaagagctaaacagggcataataaagatggccttaagagacatcttcattatgtccttaaaggacatctttatttgtccttaaaggtgaatcagagaaagggaaactttaacacataagcgggccaaacttctacctgattgaattctccaacacagaagaagggatgcttaagttcatgcttctttagccctggaatgccctcttaaataaattcaaaattctatgcgtaataacaagacacatggctgagacttttgtataggaatctatcccatgcttagcctgctgttgcaactttgcacagcacagaacccataattaggttgaccctaaggctcatggaaaggctactaaggtgagttgggtggctgtagttcctaggcaggctttttaaagaatgactcttttggtcatagttctgcctgggctaatctgacccctccagcactgtgctttctcagtccctctccccacagtgttgctttctctcactcgcacaaagaacgctgaaatgcttaccaagagaagcccaggaaggagcttgccagatgtcattcaactgccaataaagtgcccccatcgtgtgcccttgctgatccactatctcgctgcgactacggcggtagaattcagtttctgttttgacacactgggcctgcatcacctgattcaggaaaacattcatacacaggtgttattgtttgatgtagactgcctagatctgagaaaaatacagggtttagttttgttttgggttttttctttttggagcaatttggataaaattagggaatttaattagtattaggaatacattatactagatctgtaactagccccttagcatgagagaagctgttgtctgtaacagtgggtttgtctggtagacttggtgtttcattatggtgacaatggaaataggatggtgtaaaaggttctctgctaatgatagtgtaggccgtaaagaaaaacaaagactactattccagagcaaatgctatatatagtccaaaactagattattttcactgaaaaattttgctaataccttcatagctatttttaagaaaaacttttactagaaaaaattctataagaaaaataacattgttattatgagtctgatattatccaatccctaattattttttctagtcaaacaattgttttgatgtcatgatttttggtaatgtaagatttctcatgaatgcaattccttcgttgtagcagaacagatggcaaattgcagcaatgagacaaatgaatttagttcttgtttaagagacactaaagaacttcacacaggacccttgattaccgacaccatcatggaaaaatcagtctcttttatcgctgccgttaccgacacatatgaatcacatgctcttagcctggagttgtgctgaggaggggctcatgaatggaccactgaggagaacccagagatggtcagagcagcgaggatttcagagaacaagaaggccttagaatagggctggggttttcacagaggaataaaaagaatggtgcatatggccaccaaaagactaagtcgagacgctttcccataaaagcaaaaaagctcagataaaggtagaacctttaaatagaggaaggctgaccagtaaggaagtcatagatgaggttatgacttacatgagtcacagccatcaaattccagaacggaagccagaagaaattgtggtcagtcaataaatatttaataagaacctgcaggatatgttacatactgagaatggtgggcacccctgccagaaaaaaatgatacagcccaccatatggagcttatcagcttgtgtagaagacagtccttcatcaaagaatcacagaaagatacgtaatcattaaacagtaccaatgctaagtagaagaggtatgcaatgttacaagctcatatggtggggcaattgggcagagctgtagagtgaggattggcctaaaagaagaggaatgggaaaaagagagagggcagaaccttccagagaggacaatacaccattggaggaggatgccaggtcagctaagaactgaaggaaggccaagaaggcctgagcacaggaagccgggagcaatggaagagaagctggtgagaattgcaggggccagaccctggaaggccacatgttgaaggtgttggtgtgcatcctaaaggcaaatggaggtcacaaaaggcttttgaactaaagggtgatgtgagcagatttacatttccaaaagatgactgagactactgaaggaggaagggcttgcaagggggctagagtggatttaggtagaccatttaggcaagagatggttttagctatgagcagacaaagcaatgtcttctcattcaggaaccagaccactaggaccacagcaacagtagctggaaaaaatgttctaaagcaagaatctcacaaagcaagcagcattggtgccacctcaaaatgaccatggcccctataaacatttgagttttcagtctctaaactatatcaattttcagcattatctgcaagatatatttatttctatatatccattctaacattaatctcctcactataagttattttttcctggtttaataggtaaaacttattagttccttagaattttcaaaatttgaaaaaattttaaatgcaagtaggattcctaaccctcactagcaatgaaaagaaaagagcacaaagtggctctatctagtagcctctcttacaggaaattagcatgaaagagcataaccaagactcttttgtgctccaggctctggcacagtgcagtacactccacacacagatggtaccatgctaataacatggacctgaatctatccaaaccagtgggtaccagtcaaggctaatgaatgacacctttgttcataaaaatgcagaaggctattgcccactaaacttcttaaaggggtgttgtacaatcctagttccctggaaaatctctagaacttccccttcccctttaaaaactgtacctatatttacacatccatgcatcctttcctaaaaagggcaatctttacacataagagggataaatgcttagtcattttctaggttatccagtccactgttagcagacaaatgaattttagttttaaaaatatgcctatttggctgggcgcgatagctcatgcctgtaatcccagcactttgggaggctggggtgggtgaatcacgaggtcaggagatggagatcatcctggctaacacggtgaaaccccgtctctactaaaaatacaaaaaattaaccggacgtggtggcacatgcctgtagtcccagctactcgggaagctgaggcaggagaatggcttgaacttgggaggcagaggttgcagtgagccgagatcaagccactgcactccagcctggacaacagagcgagactctgtctaaaaaagaagaaaagaaaaaaatgcctattctcagcagcttgcttgattacacttatgaaatgagtctcctatgagagacagatggtatggtgagaagaaattggatcaagatacgaagacctaagttccagttccagcactgccactggtggttgctagctgtcttccaaaaccaatatccctttcctccagagtgatggagttgtagctggactacattttccagaaacacaccccaacccctgggactttgagtagccatgtgactaagttccctcaatatctatatactttatttactaaaattatcccgacactaagaatcttccaacaaagctgttttaaaaccaagatataattcacataccataaaattcatcattttagaggttataattcattggtttttagcacagtcataaggttgcacaactctttccactatctaattccagaatattttcatcaccccaaaaagaaacaccatactgggaagcagtcactccccatcctcccctctccccggcttctggaaaccacttaatctacttcctctgttctgggatttgcctattccggacatttcacataaatggaatgataaaatatgtggcttctgtgactggcttcctttttatttctgaataatattttattgtatggagatgctacattttgcttgtctattcgtcagctgaaaaattaggttatttcccctttttggctactatgaacaatgctgctatgaatctgtgaacaggtttttgcatgaacatatgctttcaattttcttgagtatatatacctaagagtaaaattgctgggtcatatggcaaactctatgtctaactttttaaggaattaacaaactgtttaccgcagcagctgaactgttttacattcccaccagcaacatatgagggttccaatttctccacatccttgccaatactcattattttccttttttaaaaatttgtagatattgtagtggatataactggtatctcactgtggttttgatttgcatttctctaataactaatgatgttgagcatctttctatgtgtttactggtcattttctttaaagaagtgtttattcaaagcctttaccaatttttcaattgggttgtctttttcactattgagttctaagagttctttatatattctggatgctggatccctatcagacatatggtttgtaaattttttctttcattctggggattatcttttcattttctcgatagcgtcttttgccatacaaaaggtatttttgttttctgtttttgatgacatacaatttgcctattttttctttggttaatttctttgatggcaaatttaagaaactgttgcctaaccaaaagccataaaatttatacctatgtttccttctaagagttttatagttttagctattacatatagatctttgatccattttgagttaatttttgtatatggtatgaggtagtggtctgaatttattcttttgcatgtggatatccaattgttccagcaccacttgttgaaaacatgattcttcctcccattttattctttttaccatttggaatgtaaattagtacagccattatgcaaaacagtatggaggcttcccaaactattaaaaatagaactactatatgatccagcagtcccactactgtgtatctatccaaaggaaatgaaatcagtatgttgaagagatatccacactcccatgttcattacagcattatttacaatagccaagatatgaaatcaacagatgagtacataaagaaaatgtgatacatatacacaatagaatacgatccagccttaaaaataaaggaaatcctgtcagttgtgacaacctggaagaaactggaggacatcatgttaagtgaaataagtcatgcacagacaaacaaatactacatgatctcacgtatacatggaattgaaaaaagttaaactcatagaagcacagagtagaatggtgggctggatgggggaaagaggaagtaccaaggagatgctggtcaatgaatacaaaatttcaattaggagaaataagttcaagagatctattgtaaaacatggtaactataattaataatgtattgtatatttgaaaattgctaacagggtagattttaagtgttctcactacaaaaaagataagtacgtgaagcaatgcatatgtttaacagcttgaattagccattccataatgtacacatataccaaaacatcatgttgtacaccacaaatatatatttttaatttatcaattaaaataaagaaatattaatttttttaaaaaaagaaaatcagttgaccataaatgtatatttgttcctggattctcaattttattgaatcaatctattatatataccttgtcttttgtcattaccacactgtcctgattactacagctttgaagtaagttttaaaatctttttttcaacagtataagatttgtcaaatgctttttcttcatttattgagatgatcatgtgtattttttctttctttactaatatggtttattatactgattaactttcatatatcgaatcaatcttgcattcctgggatatttcccacatagttatgctatataatcctttgtatatgctgctggatttggattgataccattttattgaggatttttttctgtctacattcacaaatgatatgagtctgtaggttgcttttcatgagatatgtttgtctggttttggtatcacagtaatgttggcttcacagaatgagttaagtgtttcctcctcttattactaattttttagggagttaatgaggggtttcttttaattcttctttaaacattcttagaattcactagtgaagccatctggtcctggatttttctttttacgggaaggtttttttgtttgtttttgttttttaactaactcaatctccttagttgttatagggctattaagattttctatttcttcttaattcagttttcatgggttgtttctctaggaattcatccatttcatctaaattaactgacttgttgccatataattgtgtatatattctcttatcaccttatttattttggtaaggtgagtagtaatatttcctctttcattcctgacttagtaattcaagtgtcctctcttttttctgggccagtctaactaaaggtttgtcaattttgttgatctattcaaagaactaacttttggcttcactggttttctccagtgttctaatgaggtctttatttaatgtgccaaatttctgatgcccactttacttaattgctgaaaattactgttaacaatttaaccaaacaccattattgcaactgtgaagggatagaatattacagtttaaaaagcagaaaccctactccattcattgccctgagtccttaggcaaaatatttaacttttctgagactctgtttcctcatgtatgaaatggaaagagtgatatgggtgtctggagataatgtgagaattaaatgataagatttacaaagcagttcatgacccaggaccaggcaggcatttagtagatacccaaagaatgctacatattggcttgattattaaattacatgatgcctatacaaactcctaatatataatacacaatgttaatggtcactctttcattcccctcctttgcccaccctactctcatcttaaaagctcagtatgacctggatcttccatcgtgtctcagtgctacttaccaaacaaataaccattccagggcagcaggtatcatcaaaacctgggcctacagcatcacctaccttttgtcctagttcttatgatcaagttacttacagcacaggaagataaaatgggcctctaaagaaaatgagtttctcaagaacatccccaagccatcattagatattcaatagacacatgaagaataaacaaaagcactagaaaaggctgtaagctaagggcttggtaattaatgtccttggcctggcctgctctcttagtggccaataagaggccgtgctggtagagtaagacactcaaaagttagtttagatatgttcatttagatagttggtcctcaaactagagagtgagatctgtgtaacatagctaaagagggtgtgctcatgtatatgggctattgggaatacaatataacagggcaagagggagagtaaaaggtaaggcaagattatcctggaatactaggagaattaaagaggcaggagcccatagggatatctttttggctataagacaaagagaagatagggaaggatccaaacgtgaagaaatttactggacagttttctcagcgaagactttgctaacagttgcaaatattccttaattaataaatcttctaaaaagtggcacataggcaagcactctgttcttcagaacagtatgacagactatgagaaaaagaacaggggttggagtaggaacatagaaagtggaacagagaagggttttatttctaatacacagattaaagaggactgttctaaaatcaaagtaacaaggaaaaaccctaaaaccctaacatttcctgtctgtatttcagtcaagaaaatctgacactgaaaacaaaataaaataatcataatcctgatttctttcatcacagatagcatctagtatgttggaaagtgccaaggtagacactaacaagccacacgaggacaagtccaattctgagccaaagcctgagaggacactagtgctaaattctcagacaaaaccatcaccaacaaaaactggcaacaaataactccacttgcatgcccagttcctaactatggaccttgaatgctgataagttcagaaaagaaaaattatttctatcagttcttggaatataattttgaggaaaagaataaagttagagtaataaacagctggaaggaggaaatccagcataaaaaacaatagcagaaaagtctcttatacacacacacacacaaataataatcagcctattttatatgtcagaacactttaacagagtattatctgtggaaaacttgaaagataaagtgcaacacttttcaagggacagataccaacattgcctttaaccttgtgttctggtaagttcatgaattacatataaccctggcaaaactttcctaacctataagattatgattgaaacattaaaattctcctaatcatttcatcaccttctaaaaaagattattctttcagcttacagttttctgctttagtttctatcatggggtttgtgttttcatacaggagaaaactgatgaaggtgtgagcatgagtttggattaaaattcatacatttttagatactaagataggaaaatttaactgtgattatgtttttaaaaatttcctgtctacttcagatcaactttattattgggattaggcttttacctcctctctaagaactttaaacaagtatggcaaaactagcaggtaaataaacagcgactttaatggagtcttaagtgtggtcacaggttcatgaactaaaataggcaaatgaaaaaagtaaaatgaaaccattatccaaaattcagtttggcagtttcttaaaaaaaatacataaatttgttatataactcagaaattccatttctaccctttgaaaaggaaatctatgtccatacgaagatttgtatatgagtattcctaacagcattattcataatagccaaaaattggaatacgatataacaaatgtccagcaacagatgaacctgacgaatggataagcaaaatgtgtataaccataaaactgaatagtatttggcaagaaaaaggacatgaactatacatgctataacatggatgatcttcaaaaactttatgctaggtgaaagaagccagatgcaaaagatcacatattgtataattccatttatataaaatgttgagaaaagtaaaatctatagagacagaaaatagatttatgttgtcttgcagctggaggtgggaaaggggagtgactgtaaatgggtacaagggatctttttagaatgacagaaatattctaaaattggatcatagtgatggttgcaccactctataaatatcacttaactgtacccttaagatgtgtgaattttatgatatgtccatcaaaacttgatagaactgtttttaaaatccagcaaggtgcatgccataacattcacaaatcttttgatacatgcacacatccatgtgactaccactcagatcaagatagaaaacagaaagttctcttgtaccccttcctaatcattgctcacaccctcctccacaagtgtagttaatactactttgctctctatcatcttgattgtttttttttctaatatgtacttttttctataatatacttaaatttcaatatagaagaaatcagtacagttatgtatccttttatgtctggtttcttttactcaatgtaatacctgcaagactcatccaagctgatgctgattatcagtagtttattctttttttattgctgtggagtattccactgtatgaatatactacaatttgtttataaattctcctgttaaaagacatttaggttgtttctactttggggctattgtgaataatgctgctatgaacattatttgagatatccattggtggacatatgaactcatttttcctagtgcatagctaggagcagaaatgctgattcaaaagggaagcaaacatttagcttaggtagaaactgccataaaattttccaaagtggttaaacaaatttaaactcctactaacaatgtctaaaatttccagctgtctcgcttcctcaccagcagttgttattatcaatctttttaattttagccattctgctgggtgtgtaggggtatactggtatggctttaatttgcatgttcttgatttacaacaagattgggcacattttcagatatttattgacgctttggatatcttctttagtgaagctccagttcaagatttttgtccatttttaaatagattgtctgactttttcttattgctttattctggatacaaatctttttatcaaatatatgaattaaaactattggtccccaatttgtggcttgccttttctctctcttaatggtgttttttatacttaatggtgtccataatttcaatggagtataatttatcaatactttcttttctagttagtgctttttatgttctatataaaaactctcacctatcccaaaatcatgaagctattccatgttttctcgaagctttattgtagtacctttcacatttgagtcttcagtcattggtcaaatgaagtttctaaaatttattattattttttagagatagggttcttgacattttgcccaggctggtctcaaactcctaggctcaatcaatcctcccacctcagcctcccaagtagttgggactacaggtgtgtgccaccatgctcaacaatcaaattaacttgtatatggagtcaagttcatttcttttcccataaaggtatccacgtgattcaccactgtttattgataaaatgattgttctcatactcaattgtggtggcatcacagccataaatcaggtgtccatattatacagtgatctgtttctggactctattgtgtcccattgttctattttatccttgggaaatggcactgtcttaattactaaccctttagagcaatcttgaagtagagaatattttcatacacaatttatttcagaattttgtgagctgtttttgtaagagaggcaaatgccaaaaatgaactatttcatgtcctatgtgtcatcatatatgttctttgaagaaaataaattccttaaccagtggaatgaaaacctgaatatttttcaccatatatggcctacaaaatctacataatctcttacattaattgcaggaacctgttcaattctagaatgaaaacaacttacctgagtaaggtagatggtatctttaaatgtgcgtaatggatctgtgctttgggggagtttgaaatgaagtccagcctgataaagcatttgtttgttaccaccttcgtgatgttgtcgatgaagtgaaaacttgctattgaaagaccagtcctctgtagacgagacctttcaaataaagaataagaattagaaatctgaaagttggcagtaaaactacttttctataagttcctgacaaacctggaaagtatcctaaacactagagaagaccttgaggtttgttctgtggctccagtttcataaatgttttaccatcctacttgttgccagtgaaggactagccttgtggaaactggaatcacaaaaccagggtttggtacatatatcctcccttcctccaactaagaaagttatattttgatgtttctcttaagactcttgttttatcaaaacatattcctggtttttgaaacatccactatatgtatttttaaatatcattttatctacttaggtaaacattttatctagtattcgtttgtcaaaacttaatagaatgcaatcaacactgttaaaactgtcacaattcttaaataggaataaaacacctattacactataatagggatactatgagagtagatgctttagcacttacactgttcacttgtttctcagtgattactaaatgaaactgatatacatatgtttaatttttatatagttgaagacacaaaccaaataatgttacttctctcccctaaaaaatcaattttttatggtttaagccaggcccaaattataggatctttattttatcccctaacttacaggatctttcttttgtcgtcagctcaaattaaaaaacaaagtaaaaaaaactcacatatgttggagtataccttctacaaaaaaagagaaaaaagcaataattctggcttctaggcctataatttaatgcactgttagcatttaagaaagaagacaattgctggctacatctgaaaatatccagagttttaattcaagttacacagactttgaaaaaacatactctgcccctccacccaaaaacctgaaaattaaaaaagcttaatccctgttcataaagtatgacttttcattcccagtaatcaagcaacacatgggcccattaccttaaaaggaaaaggttatccttcaggaactgattcatacccaaatataagaaatgtacactagccatattaaatttggaagtttttcctaattacagatgtttttccaaaatgccaccaccagaattaaataatgctaactactcctattatgtatttaaaggagagattcacattgacaatcatctcgcacactttttagacacacatcctttatcaatagtcttcctacgcttcctcctcttaatttattttatttatgtttattatttttaattgacacaataagtgtacacatttatggggtaccatgttataatttgatacatgtatacaatgtataaggatcaaatcaggctaataagcaaattcatcacctcaaacatttatcatttctttgtgtcgggaacactcaaaattatctcttctagctatttgaaaatatacaataaattattattaactatagttaccccaaagtgctatagaacaccagaacttattcttcccatctagctatacttttgtatcaattaaccaactctattgtccctccctggcaacccttccaccctctagtaatcattattccactctacttctttgagctgaacttttttagctttcacattggagtgtccttcctccttttcaaagtctgaaatatacctttgggccatgcagccttcttatttgtaataatttgaatctatcccataatcagtaaacctgatctttagttacgtgggaggctttctaccttctcataactatggtgtgaaaatctttcaaatttcagctataataatattaccagaaagaactggaaatggccaggcaaagttctaattactttaagaatattaactttttttaaaaaaagaatattaacttatttggtactcataaaaacccggccggatgcagtgtttcacacctgtaatcccagcactttgggaggctgaggtgggaggattgcttgagcccaggagttcaagaccagcctggacaacgtagtgagaccccatctctacaaaaagaaaaataaaaaatcagcctggtgtggtggcacatgcctgtagtcccagctacttgggaggctaaagtgggatgattgcttgagcccacgagtttgaggctgcagtgagttgtgatcacgccactgcactccagcctgggtgacacagctagaccctctctcaaaacaaaaaacaaaacaagctctatgagtaggtactattatcaccccattttacagatgtgaaaaccaggcacagaaaggttagataacttcttcagtatccaaatctaatgcagtctagctccagtccctagttcattaaacccagaaggatctgaagaaaatcgaactgtcatacaaatcatatggttaaaatggtctatactaaaggtaaatagtttacatttcatgggctctcactgtgtcaggtagagtgctgagtgcttcaatgtattagttaacttaatctttactcataaacacacgcgcatatgcagatctacatgcacacacacacacacacacacacacacacacacacacacacacacaaggtatttactaccattaaccccaatttacagatgaggaaactgaaattcagaaagattaaataatctgtccaagatgatacagataatgaatggcagctgtcatattcaatccagttctgtttattccaaagcccaaacttttaatcaccgtgcaatattgataatcacatgttaaaattatattttatgaaaaatcaatgtatcccaaattaaagagatatgttttaatcaagttgttgaatacatgaaagagcttctaaataaaagagccaaagttttatttagtttttcttttggtttattttattttcccaatcacctattcaaattctcaactaagcagtgtagcttaaaaaaagatgagtaaatcaagagataacaaatgattcataatgagcagcacttatcctcaactttttctattttaaaatatagtgtttattatctctgaacatcatcaggcatttcacaaaaatatgggataaaaataattccattatttgaaggaggccagtagaaattattatagatttaaggaaaaggtttagcaatttctaacactaatctttctaaagcgtggtgaaaagaaaatctatcagctctggagacagagagtaagtctgaacccagctacttattgtcgagaatgggaaggaaggaatgaaggaagcaagaatatttactgaattattgcttgtgtgccaggtcctcactcttttattagacaatactctacccactccactttgcctgaggcccaaaaggaaatcaaagcactgcagggtgggagatctatctgtgacctcttgcagtactttgatttccccctgggtctcaaagtggagtgggtagattattgtcgaattaaagaatgagtacgtggtacacagcaattattcagtaaatattcttgcttccttcattccttccttcccattctcaacacttgttcctacctgcgtcaggatactgaacttcatcctccttcactctgaaacaacagtattcccaaaagattagccccacaatttgggagcaattaaaaaacggggtatggaatttcacaatgtatatatgtttcaaaacatcacgtagtacacgataagtatatacaatttttcgttaattaattttttaattttaaaaaaccaaaggtagagctaaggttatgacatcattaaagttaaaagtacaatataacttcaatgtgtataagcaaattatagttgtgttcaggtagcgaaattgaaaaagattttgaaattgtcttaaaagactttttttggttactttatacaactgatgcagggggagcaaaatcacataatcatttcaatagatgaagaaaaagcacttgaaaaatgcaacattctttcatgatataagcactcagctaactagaaataaaagggaccttccttgaccttataaaggacatctactaaaaacctattgtcaatataacactaaatggtaaatcattgaaatgtactccctaagaaaaagaacaactcaaggatatctcgtcttcccactcattttctacattgtatgaaaagttctagccagggaaattaagaaaatgaaataaaaggcttccagattggaaaggaagaagcaatattattaatatctctatttatagatgacatgatcttatatatagaaaatgctaaagaatatcctccaaaatattattagagctaataaatgagatcagccactttgtaggattcaagcgcaatatacaaaaatcatctgtatttttatacgttagcaatgaacaacctaaaaatgaaattaagaaaataatttatttacaatagcgtcaggaagaataaaacacttaggaaaaagtaaaccaaagaagcgtaagactggtacactgaaaactacagtgttgaaagaaattaaagaagacatcccatgttcatgcatcagaagatttaatattactagatggcaatactcacaaactgatcaacagattcaacataatctctatcaaaatcccagctagcttttctgcagaaattggcaaatagatcccaagactcatttggaaatgcaagccacccaggatagtaaaaagaaatcttgaaaaaaagaacaaaattggtggactcacacttcctaatgtcaaaacttactacaaagctatagtaatcaagacagtgcatagtgacatgaaatatgccactggaacagaattgagaattcagaaataaaccctaacttttatggtcaattgattttcagggccaaaagaatttaatgggggaaagaatagtgtttttaatacatgctattggaacaactggctatacacatgcagaagaatgaacctgaactcctaccttctaccatacataaaaaataacccaaaatgatcatagacttgaatgcaagagctaaaactataaaattcttagaagacaacacagaaataaacctttgccatttggggtgaggcaatgatttctcagatgcaacaccaaaaagaacagattggtaagtaaaacttcatcaaaatttaaattttttgtgctgtaagtgataccatcaaagtgaataaggtgacaacccacagactgggagaaaatatttgcaaatcatatacctgataaaatcttatagccagaatatatttttttaattttcataattcaataaaataaagacaaataattttaaaatgatcaggccatgcatagtggctcacacctgtaagcccagcactttgggagcccgaggtaggaagatcacttgagctcaggagttccagaccagcctggatgatttggtgaaactccgtctctataaaaaatacaaaaattagctgggtgtggtggcacacacttgtagtcccagcttcttggggatgctgaggcaggaggattgcttcagcctgagaggtcaaatctgcagtgagccgtgaccactccactgcacaccagcctgggcaacaaagcaagaccctgtctctatttaaaaaacaaaatggctaaaggatttgaacagacatttctcaaaggaagatatacaaatggccagtaagcacgtgaaaaaaaaatgctcaacatgattagccatcaaggatatgcaaatttcctgtaaatgtaaattcccagggaaatgtgaagaaaaaaagaaaataacaagtgttggcaaggatgtagaaaaattggaaccctaatcccttgctggtagaaatgcaaaatggtgcaatcactacagaaaacaatttgacatttccttagaatgttaaagatagagctaccatatgacccagcaattccactcctagatatatatattcagtagaattgaaaacatgtattcacacaaaacatgtacacaaatgttcccagcagcattattcataatagccaaacagaggaaacaacacaaatgtccatcaactgataaatagataaacaaaacgtagtgtatatccatgcaacagaatgttattcagcaataaaaaaaaggaacatactaatacatggtcaacatggatgaaccctgaaaacacagtcaaagaatcagtctcaaaagaccacacattatattattccaattatatgaaatatgaagaataaggaaactatagacacagaaagtagattcgtagtgcctaaaactggggaggagggatagggaaaaatagggagtggttgctaatgggttcagggtttcttttgagtgataaaaatgttctaaaattaaattgtggtgctggctgcacatctctgtgaatatattgaagactattaaattgtacacattaaatgggtgcattgtatggcaagtgaattatatctcaataaagctattttaagaagaacacacacaatgctgaaacggaatctttaggaacagagagagtgaaaatccatacagaaaataaaacacaccaacatgatgaaaaagagggagagagaggagtggggtggggggggggtgggcggtggtaatggaataggaggagaaagaggagagaaaaggtaagatgacaacattagactaaggtttatttatcacatttaccctcttcctgtagtgaaatatccagctctgaatatctgtaaacggtaaaacagttgcaggatatgatttacaagcaagagttattgtagcaagtaagagttatttccgtgtgtgataataagtcaggcttaagcaaccactgggtcccattcagtgctttcggtgctcctgaaggaacacagtaaaagcaatatagaaaagtaatccccaaaggtttaaaaaaattattttcctccatcttcttctcaaactttcatttaaataagacgtaggtttcatatgattttctgaaccagtgatcagaataaacacatgcccacagtctatcattctgaaacattagaaaatcaaacgatgacttaccttttctaatgtactgaaggacggccaggactgatatccatattcagatgcaaatcgagcttttgggaaaactttccagttccagcaatcactgatatagtcataaaaatgtacatcaccaaaataattgctattagggttttgagagacccaggcttctgcaacagtttcagccccatttgtaggactggacgtaataaaaggacgactcttgtctccctgagttcagaaataaaatgaattcaaggataatatattcatcctgtaaagtatgtatcatttacttctttaaaaatactaacaagtccctgaaatgccaagtagctgatagaaaattagtaggaccacttaccttcttccctattcaacaaccaccagcacctctctgctcttcgccaatcctttatatcttttcataagtaacacttagctcatccctcacagcagctgttcttaatcttttcaatcatgttttgcctccactctcatccatcatgggtggtgtacagtctagtccagagtttcttaactttgacactattgacattttgagctggatacgtttttgttggggttggctggggttgggggtgtcttatgcattgtaggatatttagtagcatccctggcctctaccaaacagatgtcagtacccctcccccaaccttgaaaaatgtctgcaggcactgccaaatgttccatgggggcaaaatcaccatcacttgagaaccacaggtctaacaggtaagaacagaagctactgagtcagatggacccaaacgtgactttaaatctcaaatctgaaccttattatttgtggacaggtctaagccttggtagatttatctgtaagatgaggataataatagtacctcctttagaggtattataaatagtaaataactctcatgtgaaagtaatggctaggtgtccaccaattcatgttctcgtttctgtaatatagagccatccctaggaagtggcttcctagcccatatggggccatgtgcctcattctcatcctctgcccccatttgcagctgagggtgcaagagatggtgcagctggaataaggtgtctatatctctgaaagaggagctgccagcagccctttcatagtgtcagtgaggaagaaatacacttttattatgtaaaccactgaaatactgtggcttacctgttacaacatctagcatgtaagcacttaacagggtgcctagcacactgtgagaactcaaaatatagttactatcatctcagtagatgagactacttcctatttcactgagaagattcattcatttagcaagtattcgtcaagtctattgtgtctggcatttttccacactgcagagggagggagagagacagagaaagagagagagagagaaagagagagaatctatgactctgtcaagtacttatacaacaaatctcttttgagtatttcctattggccaggcatgcagttctttctatgtgctggaggttcagcagacagccatggtgaccgtcttggaagagtagatggcaatttagtgctgaaaccagatactgaacaagtaattataagtatgatgaatattttgaaggaaaagcgcaaggctctttgggaatgtaaaacatattacagaaggccagtaagccttccctgagagatagacttccagaaaataattttctcaacttttcaccattaggtttcactttttcgtggtatatccattcatatttcatttcttgtttctattctgctattaagaaaaaaaaatccttaaccctttcctttgccagactctgtgttctggtcatctttctagtttgctttggtactatagccaacaaactatcttccactccatttttttcttaatctccctctactgcccttttcccttagcttccttaggactccctttatcctaataaaaagtccctttgatcccttgtagtccatcagatttctttaccatcctctcattcctaaacccctgacattcatttcctgatcatttcactccactgaaatgtttttcaaaaattacccatgaacttctacttactaaataaagcagttctttctgtccccacttattccctctcaggtgtgcaataaatgaccctatttaccacctattatttctgaagctctctccactcctggctgtttgttcacaattcttccacattccagtttcccccaaccttcctgattcttccttctccagctaccctctccatccccagatggacactctacctctctctcaggcttctccttgttctacaccctgtcccatggcttcccgtcacatggatgttctgattactcctagccacacctgcacacttgacctcatgttcaccaccacacattgctgataaccagctccacatttccacctgtgttgtcttgccaacatcgcaaatccaaccttttaaagcagaattctttatttactaattccaaacttatctgactatgctccctttcttgctgaacggtacccagattggagtcatcttcaatttctccctctcttacctcccacattcagtcactctgagtagtagcaactctacattcagatatttttttccatcaccgaatttccaatcccacaccactggactccactacctatgacctccatgaccttggggacttaatgactctaaaataaatatatcacctacactccaggtaacttctaaaaattaagtaaataaattatacaaagcacttacataattaactttttaaaaatttgttttttaaaatttaaaaaaaattgttaaaagacagaatgttgcccaggctggagtgcagtggcatgatcatagctcactgcagcctcgaccttctgggctcaaaataagcctcccgcctcagcttcccaagtagctaggactacaggcacatgtcactatgcccaaagaattttttaaatttttttggagacaggatctggctacatcacccaggctggtctcaaactcctggcctcaaatgttccccctgcctcagctcccaagtcactggggttacaggtgtaagtcaccacatccagctttaatttaatatattaatatataataatattaatataataattataattaatatattgatgcctggcatctcagtaacttggagttcttagttgttataactggtttccttgtttagaacctctcacctccctaatctttgctagtaatcttccataaacatggaccagataaagttcctcctctcccccaaaatgtccactagcttcccaccatctaccgaataagctcaactccataatatgatttaaagtccctctatgacctgcttccagtcttcactaccttccattctcccacagtaatccaggagtcccttgctcttaggcaccaggcactgcttgctgctcattatacataccacctactttcacatctttttacctttatttacattgttttcatgacctaaagtactactagacaatgctttgcctcaaaattctccacctgtaaggtttcccttgaatgtaaccttttactcgaaagcctttttagattctttcagttaaaattaatggttctgccacatagttcccagcattttgaagctacattttttatagcactttttttaactgcccaaggtctgataatttttcccatgtttccctttgacagcagagtgtaagctccacaaagataagagtgtcccccacagcatcgggaatgaggctttgctcttggcaataagtactcagtagatgttgggtgaatttaaaaatattaaaaagtatgatgaaactataggtgatactaaatgtttaaaaatatttttgctacaatggctttgaagaacattgaagaagaaggccagtcaattggccttgattgatcaagcttgacagatttcccttcattccttgagattcttgagaaatttggcacgctgagccatgcagtaaaattacaaacaagtctctacctaaaaatatctggctttgacgatgcattataatttccttccacttataaatcctttattcttgaggtgtggttatttgttgcaaatctcacagatgacatctttctaagccatgaccttaaacccttagttggaccaggaaataccataaggtgatccaagagaatggccataaaaagaaagcatgtgcagcaggaaaccaatcattacagccaatttgtagatgaatcaatttatggtactttccctttttatgatgcctaatactttgatggaaactaaaagcagtagtggttatgtagcttttaatactattcatctttgaaaaaatttacaaacatcagttattgcccatggctcgttttaagataaataagtccctaaaaagaaaggcatatctccatttcagaggtaaaaaagaaatggcacaaagaagctaattttttaaagcttaagaatgtagtgttaaaattaatgatcaaaatgtgtaagtatctgaagatctaccttgttgaacaaaagcaataaggatgatgatgatgatgatgacgatggctagttttaattaaaaggttactgtgggccaggcgtggtggctcacacctgtaatcccagcactttcggaggccgaggtgggtggagcaggaggtcaggagattgagaccattctggccaacatgctgaaaccctgtctctatgaaaaatacaaaaattagctgggtgtggtggtgcatgcccgtaatcccagctactcgggaggctgaggctactcgggagaattgcttgaacccaggaggcagagcttgcagtgagccaagaccgcactactgcactccagcctggtgacagatgagacagatgagactccatctcaaaaaaaaaaaaaaaaaaaaagttactgtgaaccaccatctttcagtaattcactacaacgatgacacgcaaagggaaagaggaaaggcacctgatattctctaggccttttagaaaatatggagttgttcctttggccatatacatgtgaatctacaagaaaggtgatgtagacatcagggaaatgcatctggttcaaaaaggaatgccccacaaacgttaatgtgggaaaaccagaggagtctactgtgctacccagcatgctgttggcactgttgtaaacaaacaagtgcaagattgttgccaagataattaatgtgttgagcatattaagcactctaggagccaagatagctccccaaaactcaagaaggaaacaaaggaaaagaaaaagaaggaagccaaagagaaaggagcctgagttcaatggaagcacagctggctccacccagagaagtgcactgtgagaaccaatggaacagagcctgagtttctagaacctgttccctatgaatgcatggcataacaggtgtttaaaaaataaaagagctctggactgtaaaaatatttcttttcattaagcagaaatgtgttgtcccctgccccaaagaaatattttaactttaaaaaaaaaaaagttactatgcgtcagactgagtcatgtgccttccatccattatctcacttagtccacataacagctcttaaaagttagctcctatttttaacctaattttatagatgggaaaaggaggattaagtaactcacccaaggttacatagacaggaagtggcccagccaggatttcaaagcctgcatacttaaccactatgctataaaatgaaaaccctcagaaactataaatccatcaaacatgaaaaacataatatcaatattgtgaataaaaagattataaaataagtgttctgtaaatattttttaaaatttgtatcatcacattttgtgaatagaaaaattcttcatgacacatgtcttagtatatcaggtaaactataaatttgaacccatgtttttcatgaattctcaatgaagtttcttctataaatggaatagtgccataaactgggcatgtttaggtgctaatatcacatactattttaaaaaatagatgccttttcaaattgcttctggatatacccagatatttaaaacatctatttacagacacaaaagtgtaaagacaaccagattattaaatcacatgttaaacaaagtttttcaaaagttaaaacttttgaaggcattactgaaaaaaatgctgctttttctcacaaaaaggccaatttatattaacatatgtctgtataatatgccaattagacaaacagtggtgcaaagagaaccactatagagcaagggccatacagcggggttggagaccagctctctcatctctctttgtcccttaaatcacataccaggacattcatatgtgatatataccaaagtctactactttaacacatacgattacagaattttagaagtggcatatcaataatcatcgaatctagagattctaaactttttgggatccacggatggactccaaggagcatgtgacaacctagcattgtaagcactgcattggtgtatgtgtggagagctgcacagagaagttaatcctccaaaaagtccacagcccatgaatcctttcatctgctgctgcactacaatgggataccctgtattcaaacgatactgttgaagacagccctaaaaaggggcataaaacatactataccagtattcaaacttatccactttaaacatacattcttttttttttttttgagacggagtctcgccctgtcgcccaggctggagtgcagtggcgcgatctcggctcactgcaagctctaccttccgggttcacgccatgctcctgcctcagcctcccgagtagctgggactacaggcgcccgccaccgcgcccagctaattttttttgtatttttagtagagacggggtttcaccgtggtctcgatctcctgaccttgtgatccgcccgcctcagcctcccaaagtgctgggattacaggcgtgagccaccacgcccagccctaaagatacattcttaaattctactgcattaaaaatcattacttactgccagtacgagctctctgatgtttttcacatagagtgtcacatagtccttgatgtagattggccggtcagtgaaactgatatgataccaattcatcatcagcgcctcctcattttcattattgccactccatatgatgatagaaggatgagatttcagtctcttgatctgaaaattaagaaaacataaaatgattttcaaagagttaacataaaaaattcagagctataattactcataaaattaaagcccttgcatttctgcacataaattcttatgtgccaaaaacctaatttgaaaatggctagtcatgttagctgcaggaatacattttaagaaatctctgagattctttttaactagattttataaacactgatacatagggtttctcttctctgctatataaaaactgaagataatataatcccttttttagaaagagaaagaaaaggggaatgaataaactcttcactctgtggattgccacaaagaaaactttcaggaaatacaaaaggcaggagacattatattttggggattggttcttaagagcaaattggacaaattggagttctgtgtgaagaaataaatgaagcaaagcaaacactaccactgaaagaaggacggaggttcctatgcagtcctcactgagatcagaaaaccagaaggggaactagagaaggttttacaaagcaagtgagtactagaggtatgctggcagttaaagacaaatatggaatactctaaaggaaaacagattagggcaatcagggttgatgtctcctgaaataactatcaatgtcgtgtcctgagaaatcaactaacattaagttactgaatgtacctaaatataaaagggaaaattagagaatctacctgaaaaccgtgccacacgaggcctgcataaactgagctcatctgggctggccctacataaagacaaaaggatccacttgtgttatgtttgcactggacagattcagacatgtcccttcttctaatacactaggacatgtgccccagtagagagcaattaaattcctctgagaatggcagagtgagtcaatggtcaagaaaaattcttttggaacatgttttggcaatgttacctcattgatatttataggttcaccttcgctgtgatgcatgattacactgattgccccccactgatgctctcaatgtgttctccattcaagaagctcagaaactcacatagatgaaatagagatgcactgaaggtatattaaagagatatatttcatttttaaaaaaattaagtcttgtgtttttctcagccagccatataaacactatttcctttttttgtctttgtacatgcccaagaaagggacagctgctaccaactgtgactgacatatttatgccactgatgaaaatacaaatataaatcctgaagtggcaaaaagcttcagtagcaccgtgttacacacaaccctcaagctgacttagagttttatggtaagctttactttaaaattttaacaaactttgcatgcaatggctctccttatctttaataatgcatcaaagaactgaagatacataaatgttagattttaattatttatacgaaagaaaactaaaaataaaactgaaatgcttgcaacctgtgtaactacaattaatatgtttacagttattcattcatccattcatctatccactttgtgaataatccacagagtggggacgcagaggggaatgagtcctaggcctcagggagatgacaatcttgcagaggtgacaaatccttgaacaagtaattcaaagtgtgatgtgtgtctcaaaaggcaaaagatttttcccatgcttaaggtaagaggggccaaaggagaacaaaggaggtggctcacaagggcagtggatggggaagatgttccaggacatagacagcaagatggagatggtgcctgaacaggtgcagacaccagctggccggagtcccgcattaagaggatcttacaccttacccagaggtcaagaagccacctcaggggaagtgttggctagggaaggagttcgattgtactttttaaaccttttattttaaaatgaaacacagttacagaaaacaaattatgacacggtcaattatcataaggcaatcacccttgtagccaccacccagtgcagccaggccggaagccatccacgtgcctcttcctaatcacagccccttcctccttccaaaagtaaccactatctagagtatcatagtgtaatagaaatcgcttccttgcatttctgtatggtttttcacaaaatatacatctgcagacactataatatgaactctagattttaacacacttgatggattcaattcattgacatccttatctttattgaatctcaaattgtcccccttttggttgttcagagtctctcaaaatccttttgacataactttgatagcttccttgttatctgcatgttgagatattccaggatcagggttctgagcaggaatgtggtatgacttaaaatgtgtcagtggaagatgactttggcagctctgttgagtatgcacatattgaaagagaccaatgctagggagtccaatcagaaaacaaatgcaatgattgaggagagggaaaaataggatttgaattagagtagtaagcacgggggtgagaaagtaaatacaaatactagtaacattgatatcaaaaaattgtctcaacttaaaaccagatggatgtgggaggtgagaaagaagaaagtatcaatgactttcatatttcctgctaaaaagaaaaatcttgaaagagtgcactggggaaaagataatagatgtactttgaagacacgctgagttagtgtgacagctgctattatttgttatttcttttgaactgcatgacttacacgtattatcctatttaatttttgaaacagtttcatgaggagtgacatcatactagagttatagatacagaaattgaggctcaagaggtaaagtgacctccctaaggttgcagactcaccattcaagaagaaatatcaaaatatttgttctttgtatatcaacattacaaaaaatctggcagacagttggacatgagaaattgaaatcagagtcaataattatccacattgtagctttacctgaggttaccgagaaaatggatttgtttccttctttaacatgttgcagagcactataaaaactcaatatgtctccacagtcttgcaaactctttacaaggtaggggtgatctcctggtgcagtgatcatttccaatggatgctaatgaatcagtccgatgtttcagtagtattttactagcatatgatacactcacaagttggtttctaaactgtattttgggagtacatcataattcagaattttcatgtattgacaagcatcccactctgattctacatggaaacccatgccatgcacttaatatttaggggagaggaaatataatgcaatctgtgtttcaaagcatgatcatcccctaaacagaccttgctgcaaaaataagtatattcagcacacagctcataaacctcagatctgtggctaaaattatcagttgataatattatattaacaccattgccatttgtgaaaagaagatatccaggatcattttatatatttcctgtgccagacctggagtcggccatttctctaagaagcttttctcttaacaggaaagattacttcaatataagaatactcaacactacaacgttgggcattatttctagatcttttcagtaggcagagaaagcatataatcacttccttgcatttatatatctgtgaatataaatataaatgtcaatatgtggaatctaaaataaatcaaggaatcaataatcaatttaaactttctcctgagcaattcaaacagtggtgttgctgtttgctgagatggagaaaacttcagaagaagcaagattggggagggggtgcaatataagtttagtttgtacatgttacatttcagatgcctgttaaacctccaagcagaggcaccaggtaggcagttggatataagaaagaggaattcagcagagaaatcaggactggggataaatctgggagtcatcagccaatagatgatggtaaagccatgacactgggtacaatcacctaggatgtcaattacctggctgtgtaatttttcatgggatttagtagagaacaaaaaccaaaatgaagcaagatttaacaaaaggcaatactaaaacatattatttgttttatttcttcttggaagggtagtaacatacctggtaggcaacttctgctgtcactgaatccaggaagccctgatcagttggataaagggcacaggcaaacataaaatcctgccatacctagcaaatcaaataaaagggaatgcaacacttccataagttttattacacagaagaaagtctttattctgagctctgggcattatctttcacacaaatgaaaaatccagttagcctgatgagtgtgatcactggggcgccattatgcataatttgataccaagaaatgtatcaaagacattaggacttcccagaactgcacaaaatctgagaagagaaaatcctaggcaggtatagaagaaagagaagatggaagaatttgaaaaagaaaaaatgtgtggaggggacacagaatgaggcttccctccagccccttgtcactcctaattcattccaattttcaccaggcatttggtattgagatgcaccagactgttaagaatcatacttcatttataaaggaattagcttttcatagacaaaaggattactacatgcacattttagtaatgaaaccatataagtcccttcctaaggaggctgtgtgatgcaatggttaagaacacagcccctgctgggagcagtggctcacgcctgtaatcccagcactttgggaggctgaggcggggcgtatcacctgaggtcaagagttcgagaccagcctggccaaaatggtgaaacccggtctctactagaaatacaaaaattaggccaggcacggtggctcacgcctgtaatcccagaattttgggaggccaaggtgggcagatcacgaggtcaggagatcgagaccatcctggctaacacggtgaaaccccgtctctactaaaagtacaaaaaattagccgggcaaggtggtgagcgcctgtggtcccagctactcgggaggctgaggcaggagaatggcgtgaacccaggaggcagagcttgcagtgagccaagattgtgccactgcactccagcctgggtgacagagcaagactccgtctcaaaaaaaaaagaaagaaatataaaaattagccgggcgtggtgacacacatctgtaatcccagctacttggtaggctgaggcaggagaatcgcttgaacccaggaggtgaaggctgcagtgaaccaagatcgcaccactgcattccagcctaggcaacagagccagactccatatcaaaaaaaaaaaaaaaaaaaaaaagatcatagccccaaagcagcctgtctgagtcggaatttcattccaccataaatgagttgttagagtttggataaaatatataacctcttcatgtgtcagtttccttatctgtaaatggggatagagaatagtaactacatcattgaatgggcatgaagataaaatatgtagagcacttagaacaatgcctggcactcagagaatattatagaatattgtcatcgtcacaatgaccatcagcattatcattattagaataattcctagtcttcggtggcactctttatattttagaacaacaataatagaactaacagaatatattttctttgctttatcctcacaattgcaaaacacattaaaagtacttaataacaatattagggccaggtacagtggctcacacctgtaatctcaccactttgggaggcagaggcaggtggatcacctgaggtcaggagttcaaggccagcctggacaacacggtgaaaccccatctctactaaaaatacaaaaattagctggatgctaatttactaaaaatacaaaatttagcacatgcctgtaatcccagctgctccggaggttgaggcaggagaatcgcttgaacctggggtggaggagggtgcagtaagctgagattgcaccattgcactccagcctgggcaacatttttaatttttaacaaattaaaaataaaaaattagaaaaaatttagaaaaacaatatgaaacacaccttttctttacttaattttattatttttcttctctttaggtttcgtcagatctcctttaagtgttttaaatattttgttttcttttatatgcatacctaaatatcacaaagaaaattattttaaaagtaggtatatgtatactgggatataaataatttacaggatatctatcatttaaaaataaataattatggtagttgatcacctatggctcttggtttacaagatgccatttattcctatagccccaaatggaatatcattcctagctctgagactggggcaattgcatcattcagaacattggcagtcaaactgaggatatagtaacttatcaatatataaaatgctatcaacttctcaccattattcctagttcatcacagagttcatagaattcatcctgctcataaattcctcctccccaaacccgaagagtattcatattagcatccacaacagactgtaaaaggagccgtaacctgtagaagacattttagaaacaaatcataatttggaaaaaaaaaacagattgtgacagataaacacatttctaatctgttagaaaaacacactctaaaatcatgatggtttggttacaatgtaaattaaagaaagtaagataaaattatatacacattaactataaccacataaaacaaataaacagaaaaagtatgggtgatatctttacctattaaattttcagtaacattattatactctttttaaaattaaatttatgttttatatttagtcttataaaaaatacagttgtaagccttggaaagtatgcactaattttatacaaaccctccaaactataaaacaaaatcaagacttgagtattagtgcctagcacccctatctccttttatgcaatttctccagcccagtatttctttctctagtaaatttcctttctactttttccaattcctattcacattaccctcaggaaaatctagaaacttacaggcagcttgagagcatgtaccttccctccattcccagaacagtgctcaaaccaagtaacaggctgggcagacccagagcactgtgggctcagcacaggcaccacggcaggcttaccaattggcccagttgggctgaaggaccacagccaacccagccccagctgggaggggagaggagcatttgaaaaggaaaaagatagagccaattatcccgtggctgtgtctggagaagaatttcattttcttatgaaatctaaaataatatacacattttaaagtaaaaggaaattactacaacttttggaaaaaatcagggtttagttactgatgacatttacattctaaacatcaaataatatactacaatgcacatttatacatttgtaaatatgctaaaatgttatttaatttagataataaataagtttaaatgtgtttattttcatttcataaagtttattttcagcattgcaaagatttaagtttacagatccaattaggaaatattattttcttccaaagttctattccttcagtcttggaaaaacattttttttcctagatctagaacttttaagattatattttgtttttaaataaattgtattgtgtatatttaaggtatatgacataatgttatgggatatatagatagatagttaaaaggttactatagtgaaacaaaccaacgtacttaccatcctacaacaggggtcccaacccccaggccacggactggaccatggatcaggtggcacagcaggaggtaagcagctggtgagcaagcattactacctgacctcctatcagatcagcggcagcattagattctcataggagcaggaacactattgtgaactgtgcatgcgaaggatacaggttgcatgctccttatgagaatctaattcctgatgatctgaggtagaacagtttcattccaaaactatcccctcatcccccacccccaatctgtagaaaaactgtcttccatgaaactggttattggtgccaaaaaggtttgggactgctgtcctacgtagttatccactcttttttgcttttgtggcacaagtagctaaaatctactcacttatttaccatgaatcctataaatagcacaatttttttaacctatattcctagtgcacatcagatctctggacttgttctcttgcatatctgctacattgtatcctctgaccaacagctcccagtttcctccccaccctcccacaaccgcgcctccactacacacgagattttgtttagttcttttgttgagataaaagtaaaagaatatgcaaataccttagcatagaaaggtaaatatggggttggcccggtggcttacgcatgtaatcccaacactttgggaggctgaggcaggtggatcatttgaggtcaggagttcaagaccagcctggcctacatagtgaaaccccatctctactaaaaatacaaaaattagctgggcggtagtggcctgcacctgtaatcccagctacttgggaggctgaggcaggagaatcgcttgagcctgggaggcggaggttgcagtgagctgagatcacgcgactgcactccagcctgggcaacagagcaagactccatctcaaaaaaaaaaaaaaggtaaatatgtgttcttatctttcaaaaccatgctcaaaacatttaacgtatcatttgaaaagctgaaaatagttgaatgtaatatttttttcggagactattcaaaatataaattactcattttcttatttctccagaataaacatataatagttttctaaaaatcgaatggcttcaacagtctcaaatagtttagctgtaagaccacctgtaacccaggagaatggaatatataatttttaaaatcctgtccattctgaagtttccatcgtctagaattctatactacctcttagttccttgcccagagactaaagaaagtaaaaatgagtaaacctcaagctttgcgggactgctaattaaaagaagaacaagaaaagaaagacaataacttacaactcagaggttactcggtcctggaatgaatctgctgggatccagtttgagccttttagaaatatgggaaatccattaattttgaaatagaaactcaaaccaggagacccttttataggctcttctataagttccactgtcctaaaataaacctgcaatgaacagaattaaatgatgaatatcaaatttaaacataagcaaaatagtttttttaaaaaaagcagacctttttgaaaaactacattcagtagtttaatgctaattttcctatttactatgaagcacataatgtggaaatgcacatttcaggaatatacacatataaattattgctagcatccgttatttctcttttaaaagagaaatatagaaaccactaaagagctactgtagtcttccacatgaaataggcatttgtgataacatcaaaaaagacaatttgaagataacatctctaaattaaaacaaaaacatgctatttcaaaaaaatagaaaaaaatgctgtctttgaaaaacacattctcatttcagtgttgttaaaaggtagccaaacatgcatcttagaatcaaatgttataacttaacaactttgcaatcttaataacacattaccataaaatcactttgtttaatgggtaatttaatcctaattacacattaaactcaatgtttgagcacgctctggtttcttgactggagatgtacatggtgttctaatggaagtagatgcagcaggaccacgcactctgtgctattggtgctctggagaggaagcagaggctccatcctagtgacagcctagccaggttttcccccagttaagcatgggcagcaagaccccagatagagaagctttgacatttttatcaaaatctttattcttgccagccataaattggatcaagtttatataagattttataccaataaagcctagccttaagccaaaagcacacatttctctaacttaaaaaatcagtgaatgaattagtcaaattatttcatgtaataaaagtgtccaccattctcctgcttcctgactcctgactttatttatatgaaatgacaaaagacctcagaattaactttacaagaagatacagaatatgtcctggataaggaggatcttgacacgcgatgatcactcctgcttcagggttgcaaaatgtcaagaatgcacagtgattttcagaggtgacttttaaaacaccatgatggtgggttccaatatctagaacagtgcatggttctttaagtgtggcctggggactccaggaggtcccttggagactgtcagtgtgtccttgactttacttagagtaaaactaaaacattatttgcctttatctctctcagtctctgagtgtcagtggaattttccagagactacatgatgtgtgcctacttcatcactctgacagctaatggaatgtgtgctgtgtattccactgtgatgtagctctgcggcagaggtttatggtatgaagcagtgcattttcagagattaactcagtttgttctcagtacttttactgtgctcttactattaatagctgtctttgattattcctgctgtaatctctgtaccctcattgttgttcaataaattcttactttgaaccccaaagtttcccttgcaacctacacaggagcacaaaaggagtaggtactacttattcctttgtttcacagcaatatttttaagttttcaaataaaaacaaattttaattttaattgaaactcattttacactttaataatattttatcttgttctaaaagaaaatttatttataatacttttttccaatttagggatgaattgtcaaaatgggattagaaggcttaccttctcaccagcctggccaacatggtgaaatcctatctctactaaatacaaaaattagctgggtgtggtggtgcatgcccataatcccagctacttgggaggctgagacaggagaatgacttgaatccgggaggcagagtttgcagcgagccaagattatgccattgcactccagcctgggctacagaacaagactccgtcttgaaaaaaaaaagaaggcttaccttctcaacctataactgcactatctgtctatatctgaggatgctgaaaaaagtgaaactgacatatcagacagtcttttgactcatggaagggaagaatctactctaaacaaactgggtaaaattatgaataagaagtgaaattatgatgaaagccacctttctcttgactttatggatgttaataacttacctttttgtgcgttatgcaatggaacatttaaaaataatatttatggtgccagttaagttgtagtgtctcattgagacaaatcattcacagtatgaagaaaagagaattgaatatttaaacttatacatgataagctcattaaaagtcaaacagtgtttattacatcttttcaaaccagacatgaaaaaacccagtgaagcatcttacagggttagttatgcacccctggctggagaagcacacatactagctgagagacagttgtactgttgacattgcagaatgcttactagatgaaaagttagtcgaggaaataacagcactgccactttgcaatgacagagtaactcgtccaattaagagatttgactgcaatatgaagactggcctgatatctcatctgaaataatcatacttttgctttacaaatgagtgaatctccagatatagatggacttgccagtttgcctgtatttgtctgttatcagcacgataaatcatcaaaaaacttcttttctgtgaatttttggcaacaatatacaagaggtgctgaaatattcaaagtactaaataattttttgaataatatcctgtaattactgtgttaacatttgcactgacgttacaaaagcagtggtgggttaacactgctggtgccttagcaggaatcaaggcagtagctccaaactgctagtagtcattacatctttcaccttcatgcattagcagcaggaaaatgaaaaaaaaacagtttcacttaagactgtccttgataaagcagtaaacattaatttcattaaatcccaaccctcagtatgcatcattttaatatcctgcattatgaaatgagcaatatccataaagcaccattcacaatagatagctggaggaaaagcctctgggccattaatagagttgtatgtaagctgaattggccttgttcacgacactccatttttacttgatagaaagaaggactgacagacaaacgatggttattcagacttggatacctggcagacattctctagaaaatgaatggagtgagcctatcatttcaagaaaaacaactagcagtatttgtggccaaggataaaattcaaactttcaagtaaaaattgggattagggaaaacttgtatctactacctcacggtagtagatactacttaaatacttaaaaactttttagatgacatcagtggtgatattaacaaatgtgatattataaaaggaaatgtttcaacatttggaagatctgtaactctcaagaaacaaacattttccaataaccaatgcattatattacaatatcacataatatgggtaaagaattcacacaaagtgcaagatagacaaatgaattttaatgtaacagagaacaaaaagtttaagaaactatcatttgttaaaagaaaactatcattggttaaaagaaaatccacaatttatctgaaaagactattttttcccttttccaagtacatctgtgtgaggtcagatttccttaatctgtttcaaccgaaacaacatattgcaaattgactgaaggcagatacagatgagaatccctttgtctcctactaaacaagacgttaaagtgacttgctaacatgtaaaactgtcattatttccactggtttttttggtcaatatattttttataaaataagtcatatataaaaacagtcatatgtgccatggtttattatggttatttaaaatgaataagtaaatacttaattctcagttttaatatttaatatggtaaatatcggtacatataacccatataaacaaaagcatgttggggttttcaataacttttgtaagtataatgcagtgctgagtccagaaaaatttgagaatcactactgcagaaaatagaatttatttgtttcttaatatacattaatgctacaaattgtattaactatacaacataacactttccagaatatttttcctttctgtgcaaatgttcttataaaaaggcatctctccctatcccccaactcttgcaataacaagttatgactggggtgacaataaacccaaaccacctgacagtgcctcagaggtgaagtagtaattaccagccacctttccctctgggcattctttcacaagtgaaaggctcccgcttctatgataagtgtcagtaattttccacgtcctctggcagtcttgatagtcacataaaagccttcttctacaacaggtattttacttcagagaaaataatgggttctaaaagatttcttgaaaagacccttgagtaacacatatttgcatccaaagtaaatatataatcttcatatgagactaaaattttttaaacagtccaacaaagcaaattattgtctaacagtaggaaaaaggtataaatacctaagaaactaaaaaatgtgtaagtcgggcagttagaaaattaaaaattttaacttctaaatttttatctatttttgaagtttctattcctcactagatcagtgtttttattagcttcaaaaagatttcattttcaaaatagaaggattaactttaaaagtgcaggatagttgaatgcattctttcaaacaagaattaaggatatctgaactaaagggcctaagaggtacgtgactgataaatacggtactcctcaaatttctttctctggcagaccaaacagatgatatgtaatgaatcattgattcacaaacccaaggctgcttctcagctgtttgtatcagatacttaaaaagctgtaatagcatcactacattttcaaaagggcaattttcttcttaaaaagaaatccacttatttctaaacattgtcaaatgtcaaacctgctaaaatccttttacatgtattttaagagacaaccaaacactgcatttctgtctttgttctgaaagtgctcccccatgtaaaagtattgagaaaacaagctctgggtctccacaaatagctcttgtcaaacaggtctgtgcaggatgacacaagagacattctttgtcgtgcccttgcaatttgcagacagcacaaccagaagttaacagattaacattgacatcggcacagttatgcatccttgtagccagatgtgtatctagtatatctgacaccagataggatcactttttaagacctcctcttccatatgacaaagttattttcaatagaagtaatgaaatgaaatgaataatgataatgtccagaaaagaatgtagacattaaaaattttctttccctgaactttgtataatcacgccagttttttaaaaaagtaaaacaaatattagcgtacaaaaaaggaaaagttaatagattcaagttttgattatattaatatatttaataaaattataaacaaagggaataacatatataatggtatgctatagtaagaaataataatatttgctattttcagccttaccttctaaaaatctgtcaacaactttctcaaaattgatcttctttggacatacatgttcaacaaagggtatagccagctcttttgatttatttgtcatagctgatggaaaaacaccttttattaattttaactcagaaatgttcttccagatgaggccagagatatgcaaatattttagaaaagtattaaacataataagtttggtagagattcataataatcccacatcacattaaactccaaaaaaatgcagtcatatccatgcctttgttcttttgactttcattcaaacaatttacaaatgcctctgaggtataaaaaaaaaaaaaatcccacttctcaagtatttcttctgtaaaatcagagaaaatggctaaatgattgtgaacacagatactatttgattaattgctgtagaacaagtgtccagttctcagggacaacaattggggcgtttggcattgctatgtggatttctctgagcaatggaaaaccagcaactctttgttgtttctcctggcactctccttcaaaatttgattcttttttctatgtaaatgttgatttccttatattttgttgttgcacagtaaataggcttcaccaaaatttctgtgcacttatcttcaaagaagaattttaaagtttggtatttcactgtacattgttcaagatggagtctatttgcaaatatttttgtatctgattaatgtcatctaaaactataccagaaaaaagataattccagagagaaaaccgcacacagcagagagaaatgtctgagctgattcacgtgtccacattttctttggattacatggtacttcagagttgagattaacttttcaaaatttttctactgtggcccagcttcataatgaaccttccatcttgtctaggaaagcttttctgcagcttttcccatcaatgaggtgagatgagaaagaatgaatacaatttgtccaaagttctaaaaaaaaaaaatcacacaggaaaaaaaaagtttccaaaaaagcaaattccacaaggctcagagaataatttccaagaggctgaaataaaattttggattaatttctttgatttttgcatgaactccacagtgaatactggccacatatgcagcatcttttatcctggcccatagcagaggtttatgaaataataatcccattccttgaagctattttctgtgcattctgcagcagttgttctggaaatatgagaatgactcctttatctccattctactaccttccctatgaccagttcacacatttgatctctgtttccagaaaggtaagaatgacttctttatttccactctgccaccttcaatataggcctatctgaccaattcacacatttgatctctgtttaaagtatccagagtgctgtcaaaaagaattccagccaggcagtggctcatgcctataacctcaacactttgggaggctgaagcgggagggttgcttgaggacaggggtgtgagaccagcctgggcaacatggcaggctgtgttgcaacacccacttactgtctgcacctaaggctaactactccccatctctagaaaaataaaataggcaaggcatggtagcatgtgcctgtagtagtcctagctactcaggaggataaggtaggaggatcactggggcccaggagttcaaagctgcagtgagctatgagcagcctgggtgacagagtgagcccctgtctctaaaaagaacaaaataataataataattctaaagcatttttttcagtatctgccaccccctactaaagcataccactgatgtcatgttttactttgactctttctttagtttcaaaacaacaaatttaaaaaaataaatttcaattctaaagacactattaaaattagtagaatatacttcatacatgaactaaaatatgcacttaccaagcaaaatattacacattacacctcagagtccatagctttctcaactgtaaatttaaagcataaaaataactccaagagatcacatcgaattgaagtaacttatgttgagtttctccttttttataatcactgtgctattgttgtttatttctaatctgcaatgcttttaaatgcaggcatgtatagggcagggaatggaagcacaaactgtgttcaaaacaagctcatacaattccaaactgttataaatttgctttcaaaatgactgtatgaagctgaatcttcatgtatccgggaatgactgtataactaagagtactccaggccaggtgcagtggctcacgcctgtaatcctagcactttgggaggcagaagcgggtggatcacctgaggtcgggagtttgagactagcctgaccaacatggagaaacccccatctctactaaaaatacaaaaattagccgggcatggtggtgcgtgcctgcaatcccagctactcaggaggctgaggcagaataatcgcttgaacctgggaggcagaagttgcagtgagccgagatcacgccattgcactccagcctaggtaacaaaagacaactctgtctcaaaaaaaaaaaaaaaaaaagtactccaaattaactttcatgtagaatataatgtctattacaggactggtaataaaaatgtgccaaatctaagcatacatgtatattattaacattcaagagtaaccaaacacatagttaaaacttagaccaacatatgattggtggagggggagggtaggagaagtattctatcactggcattatttattaataggattgccagtatatagtaataatgaaaaacaggccaatctatagtctacacacaattcacccacttactgtctgcacctagggctaactgctcccaaggcccacctggagaagtcactgcctatagccatcttggaaatatttaataaaacttctgacaagaataaggccaaaaggacagtgtactgggttgaacagtgtccccccaaaattcatgtccacccaaaaatacaaccttatttggaaataaagtcttcgcaaatatatttagtttagttaaaatgaggtcatactgggccctaacccaatggctggtgtagttataagaaaaggaaacaagagacacacacaaggagaaagctatatgatggtggagacagagatcagagtgatgcatctacaagccaaggattgccagcaatgatgagaaactggaaggggcaaggaagaattctttcccagagccttcggaaggaacacagctctgccgacaccttgattttggactccagcctccaagactgtgagaaaataaattttaagatactcagtttatagtaatttgtaataatagacctagaaacctaatacagaaggagacacacttcataatctctgtgccctctcaatacaaaaatacaccttgattattcctaattccatatctttggctatgtacttttaaggtctttagagagccaagagtagcacttagaaaaaattccactagtattatgttggttttttgccctgtgcaatttgcaaagatgaagacaggaatttaagaaacaaagaacaaagtgacattaaaaaagaaaaaaaaaaactgaaaaagaaaaaaaaatcccaattgtttttctaattgtagtagccatggacaatcattcacctcctctggcttgggaactatgaaacacaagttttaattgattgtagagtacttattattacatctattttcctacaataatttaattggagaatcttgatcccaggagcaaacgtacacagcaacagccttctgctgcttttagcaaaacgataccttatacatagaatacttgagaaattcttataaaataaattaggtgtaagagaaatatcaactaattggtttcctgtttttccataaaggcaagccataataagcattcaaaaatatgtattagttcattaaaacacgttacctagtcaattcagtacaatcaattagtaggataaaaacactcagttaacctgggcagaaaatggcaaaaactgattggtcagattttttattccatttacccagagtatcctctaccattcccacttatacacaaaactttttcttttgttaaaaaatcaatttggtttcccaaactgataaagctaactctcccagactcacattctaaggtccctcaggcaatgatttatttggcagaatttatgatatcccaacatttattttttattttgttatttattaatgtttaaattgcctgttgatattttccctatattacctcccttcttgcttaaaccatttgccccaatgtcactcaacataagaaaattctcagtcatcaagatattctgccatgttcacaaagaaatgtagtcggccctttcctctctctcaagtgtctgcattcttttcatgattccatacatttctgctgtatgggctgcattcaaaatctgtaacttccccaggaccttttgtctgagtcagatatgctgctgtctcctgatatactcagttaaaaaaaaaaaaaatcctaaacacgtttctaagctcagtggaagaggagaggcatgaaacaaagatataaaactgaagcaagatggatttcaatgaggtatatttaaaacagaattatttttgcataaagcaagcccagggtaacaataaacaagagcaatagaggtgaaataaggaggggctggtgatgagaaaacagtgttcaatgtcctgtctgacacagtaccaagtgctggcgagcatgaggagcctaggcaagtctcatataaccactttggatggcagtttagcataatctacaaagctgaactcatgcatcctccataatcatgccattccactcccagcagacatgccgttgggggcatatgtgctccgagtgttatatcagtaatgttcacagcagcattacttggaatagccaaaactggcaactactcaaattgcaacagcaaaatgtgtagtataataaaattttatacaacttaaatagacaaacttacagttacacagaacaataaacagcagtccccccttatctgcaggggatacgctccaagacccccagtaggtgcctgaaactgcagatagtaccgaaccccatatatactatgactttttctgtctgataaaggagaaggctgctgagtgactaacaggtggataatgtatacagcaaggatatgctcaacaaagcgatgattcatgtcctggacaagacagggcaggacagcacgagatgccatcatgctacacagaacagtgagcaatttaaaactcatgaattgcttatttctggagttttccatttactattttcagaccacagttgaccatgggtaactgaaaccacagataaggaggcactactgtacctaaatgtcaaaaacataatgctgagccaaattagccacacactaaaaaatacatgctatatggttccatgtacataaaattcaaaaagagacaaaagtaacctagtgatggatgtcaggatagtggatcttcgggaaggaaacaggggtcattactggggaggctcgcagaagggaggggagagtttgaggtgtgaagtgctagtaattaatgttctgtttcttgaacatgttgacagttacctgagtgttcattttctcataattcattaagcttttcacttatggcttgtgtatttttctgtatgtgtcatatttcacaataaataaaaaataaaatgttgtttgaccaaaactccctagctttctttctcaggcttactttttcaccctaaaactccactgacaaaagtgtttgccagtcttatagaaagaaaatatactttaaatggtcctagagaccttcaaaattacctccatcctcaagctgcatcctttcctcccatgtgttatctttcaccactattacaacgaaaacagagccccccatcccaaagtgaatccatcctcttcttatctcctacctcccagagaccttgccctctcaactacctccctgctttctaactctttttagtctttccctcgctactggcccctttccatcaggattttgctgttgctttccattctcttaatggtatccttttctatgttgaaatcattgcaaacttgtaataaagttccaacaataatacaaagaactcctatatataatacaaagaatccagagacccccccattcaagttttcatcagttgccccaataacattatgacaaaaaagatcactgcactgcacccagttcgtacatagtctcttccactgtaggacagttcctcaatctttccttgacatttttgaagattatagtagattgaagactgaagactgaagactgaaggcccttgtgtcctttcaatgtgtcacattattattgagtacctccttacttcctggaacagcaagatatttcaggctccagctcgagaatcagtcatttctccaaagagccctgattgctttcagcacagagtggtattccaaatcaacatatgggtcctaaatctactcactgctactagagagccactcttcccaggcgctctgagaaaggattaggaaatgtgtgaaaagaactaggaaatgtgtgtgtgtgtgtgtgtgtctacccacacatacacatgcatttacaaagacatttatttctctgtctacacatactgaaaatcataacttcatactattagctccaatttgaatccactgtagctttccccccttctatgttgataccacctttctccattcatgaaaaggctggcttccaccacttcaatatatttacttatttgttcagttgcctatgtgaagccaatctgatcccaactggccaccattaccacctggtctaagcatagtttccaatcagacgctttcagaagagttgcctatattcaccgtctttacttccataccttgagtcattcctcaacccactacaatttgatttccatgctgatcaaggtgaccagtaatctccttgccaccaaatctaaagaatctttctcaattcttttctaacttgaactcccttgcagcattcaacactctgaacattctttgcttcttaaaacactctttccctctggtttctgtgactccccactcaaattggttttccctccacctcgtcaaccattccttcttagattcttctactggcttctccccaaaccccaaccttactaattatgactgcctggggttctgtcctagctcttttctctgtgccatccctgaggtatttcatccgctaccatggctacaattatctacattctgctaacttacacatctatatccttaacccacatgcaatccctaagcttaagatctatctaatgaaacacctatcaaatattattccttgggtgtctctcaatcaccccacacaaaacacatctaacactgaaataatttccacccaaccccttcccccaaaccttctcttctttctgagtaatgtaactcaatgaacagagttgccctgcctgttcagaggctgcctgttcagcagcccaaaccagcagctgaggaaccattcctaactccttcttttttcccacccccacatcatcaagcctgctgaggttatatcctaaatctctttcagatttatttcctcagcagttctgtagaccaaccaatcctcattttttgtctgaatcaccaccacagtcttctaactggtcccctactcttgccatccttccaatctgatctacacaatctttgtaaaatatgcatataatccttaccccctccttaaaatccttccaagaatcctggcagcactcaggacagtgcttcttccttcacgtggctcactaggccctgcaggactttgtcctagctacttttacaacaccatctcttgttcttcaacttcaaactcaaccacaactgcattgaaatttctttcacttctgcaaacacacaacatcctttctagtccttgggccttcacgttcttttccctccgcctctttgctacattacttggccaaattctacttatccctcaggacacaggctctgggaatcttcccagaatgcccctgctctgcacttccatggcactctctacatctctagagtgctaatatattccaatggctcatttaatgattgaacttcccaatcagatcattagttctactaaggtctcagagagaaacagaaacagtgtcttagtcacagctctatcaccagcacctagcaaaatagccaaaacacagtaggtgtgccctaagtatttactgaatgaatcagcctcaaaaaatagcaactctacggcagccacagccaaagagcacatttcacacacatgcattaactcaaggtgtggggcagttaaacatcctccttaaagcaaactcctgttgctgctcgattcaaaggctggcatctttatgtgtaatgaacaataatacagtcatattagcctgaatgtaaaagaattatttcccttagaaaaagacagaagttcctcttctttctctgtagtaagttggaatgactcattattttttacattttcatgaaaacaacacacaacaaactcactgtgtgagacagcacacatcctctcagccaagaggggtacgacaagagtgaatgctttggcccttaagacgggtccaggatgttctccctgtacataactctgtgcatgtgtgcgtgcgcgcgcacacacacacacacacacacaaacacacatacactctcttcccctctcacacacacatacacactctttctctctctcccctccccccttacacacacacacacacacacacacacacacattcacagtgtctcagaaaatacacagcatgattgaacaaaagaaaaacagaaaatgcactcctgaaggacatatctccatccttagcatgttgtctggcccacaggagaggaaataccaaatgtaagaggtgacaccagccaactgtaaacaccgaagctggtgtctgggagaggaggagatctttgaagagggttaataccatttctactaactatatgccatgactcttataagccagatccaagccatctcgttcttattgtccctattttacatattttgagattaagtaagtagcctatagctaataaataacaaagtgcagttctttccaattcctagtgctatatcctaaaatgggtaaaactgaaaaatcagaaaacaccagtagaagcaccttattcagaaaaatgaagaagaatgtcagaggaaataaataaaagttaaaaatggttggttctggggagtaggaagtaagaataggaagtgatgggcaagaggtcttatttttcatataaacttactagtaatatttgagttttaaaattacacatgtattattttgatataaggtacaattttaaatcatagcaggagactacttattgacaaaataatatctaaagtatgatccatttaaaaatataaggccgggcgcagtggctcacgcccgtaatcccagcactctgggaggccaaggcagtagatcacttgatatcaggaattcaagacctgcctggtcaacatggtgaaaccccatctctactaaaaatacaaaagttagctgggcgtggtggcgggtgcctgtaatcccatctacttgggaggctgaggcaggagaattgcttgaacccaggaggtggaggttgcagtgagccaagattgcaccattgcactccagcctgagtgacagagcaagactctgtctcaaaaaaaaaaaatatatatatatatatatatgtgtgtgtgtatatatatgtatgtatatatacacacacagagagagaagcttttgaatgctgttactaaagatgatctctgatgggtggggacacaagagttttgacggtttcttcttttcccatgaagatctgtattactatttttaaaagaaataaaattatttcacaaaatattttaaattacttacttaccttagctgatttttcaatatttaagcctccatccagttcaaaaagaacagtcatgttgtacccagtctggtttccatgtccatgaggccaccaagtttctacagtaatattcttttaagaaaatttaaaagtcactctaatatgtcatattttcagcaaaaaaggctcaaagcattacatcaatttctcaaatagtcaagtacaaaactctaggttctaaaacaatgtaagtctccccacctatattatgcccaatcagaccaattcattgataatatttaaaaatcagcatgctgggaatctagcatggatcaatacatcaaaagcaaaaggaaagaacagaataacatgagtgttcagaaaaacaactctccctatccctaacaccgagcttacatttattccacattcttaacacttaaaatgggactctgaagttgactcttctttcaagccaaaaactaaaaatcattttgagttcttactttatctcaacagctactgaatgttattttgctccacctttttcagtacacaattatcaattagaggaatagaaaaaagaaaaagaaaagataaaaataatccgttctaccttgatatatgaaagatcatgagtttagaattaaaattgtgcatgtagaataagtatcaataatcaaaataattgacaagtatcaaaaataaccactgctatttaaatataatccatagaatgtattttggctttaggatactacaaatactacagaaaattaaaatacaatgataaaaataaaatgagagaaagaattgccaaattaataatatattctctattttcttaatcttaaagtttgggaaaatcattctttagctcatactcacagaaaatatatgagagactaaaatagagaagaaaatgacaaatataagcagagaaagtagaattttctttcatacttagtccctcctttctaatcatttctttagcacaggtattgcttttcatccagtgcttctcaggaagtaccatcatttaccttgctaatgttcacaaatagctcaacaatccttttcccaggttgaagttcaatgctgtatgtctgttgtgtttgcaacttagggatggctacgatcacttgaccaccaactggctttgagctgacaacatcaaatgtagactctatttccagattccactcctgggcactcttatctaaaatataaaaagaaaaagaaatatatatatatatatataatatgctaagcattatcactgcatttctcaggattcattgaaggtaagactaaagcagcttcaaacccagtatgtgctccacaatgctgtcataatcaaaacttcgtggaaattttcttttaatcttcagtttaatccttcattctgaagaagaataacaaaaatggtatattttacatagacttccactctaaaaatgttatgattgtaagtcataaaaactttatggagcataaacagaaaatgacaaatggaaagataaaataaattttccaagaataatacacatttgttcctttttaattaagtaaaaatactttataaagtaaaaagtaatagtattttactttataatgtaaatgggttttaaagttatgtaataaggtataaatttatatgtattaaaattaatcaaatgtgaaaaaataaagttatactttaaatgtagataatttatccaataaatatttcctgaggactttctatgtgccatatactctgctaagtgatgggaattaaatggtgaccaggataaacatggcccctactctcatgaactaaaagtctatagacaaattcaaaagcataataatatcaggacaggagaaataaaaggttgtcctgagaaataaaaacaggacatcagaaagcacagctaatacagagagggtgaaggaaggctttctctcttttctttttcctttttttttttttttttgacacaggttctcactctgttgccccgggagtcacacaatcatagctcactgtagctttgaactcctgggctcaagcaatcctcctgcctcagccttctgagcagctggcactataggcatgtgccactcacctagctaattttctttttactttttgtaaagatgaggtctcactttgttgtccaggttagtcttgaactcctggcctcaagcaatcctccagcctctacctcccaaagcactgggattataggcatgagccaccatgcctggccaaggaatgctttcattagaaagtggtatctagctgagaccagaaggatgcctcagctaagtacagaggaagatgataaggattctgggcacagagaagcatgtgaaggcccatgagtgagacagcaatgccataacaaggaaaacaaggaacttgggcaataacaaaattgatgagggggtcagcataattgaaaagttgagcacggtccaaatgacactgggtcttttcgaacaggtaaggagtctggcaatttcaccccagatcaatgcggagtcattgaagatttttcatcaaagagcatgaccagatctgcattttataagaattgctaaaggtcccagcacagtgatatacaaggatgaatatgaaagaagcagaaagatataaaatctctctgtgtacaaaaagccccagaaaatgccacttggaaaagccaggaacagagaggaggcaaagaagagtgttgatcagaaagaagagaaaacaagaccgaagaggagaattatagggaaagaagaaagatgagggatgaactttgggtgcagagtttggggttgtcagaatgtttcgaagaggttttgaagtagagttttatatacgcgcagtatgactctgtcctccatttcctgtcaaatttatattgtttgtataatgtctccgggtttggttttgtgtttagtttttatttttaaacaagatagagcactgggacagacttgggacaagagctgggtggaaaaacagaccgttttttaaagttacgcagaagaaactggtcatgagatctcaaaaaagcttggaggtacagggggttagagtcagcaaaaaaagttctcattctttgctgccacagaaagaaaggagaagagcagtgactgtgcagaggcatttaagtttctatgattcgtggcaaagtatggagggagttcctatttagtggcttctatttttctccaaaggaaggggagggggaaggctactagctgagaagtatcttagagacctttctcctacaaataaagaagagattaataatcatggctttgctgcaaaagaaaaaaaaaaaagctaggtttctatgctgatcaatgacaaaagacgttataaccggcactgtttacaactgtaggagcacaccaggcctgttctaaagatgaccccagcacagtttatcattcgcatctcccatcagccaaaagcatagatttgatgcacattgaagtaaaattaatcctggacttaagaactatttttgtttattaagtgatttattctgagaaatactagtcgatgagctctgagttaggtttgttctgatccagttaattttgcaggttacttaccgatagcctccaggttttgaatctatcagctggtagatcacctagtctgctcgctcaccagtgtttaatttcctctattcaataggttgtcaaactatggtctttgggacaaatctagcccacctcttgtttttataaataaacttttattggaacacagatgttatggactaaatggtggactcttcccctaaaattcttatgttgaagccctaacctccagctttttatgaagtaataagggtggggcagtaatctgttaggattgcagccttataagaagaggaagaaacagatatccgtctctctctctactatgtgaggacatagcaagaaggcatctgtctgcaagccaggaaacgagccctcactggaaaccaaatgggccaacacctttatctcggacttcccagctgccagaactacgagaaataaacttctgttatttaagccactctgcctatggtattttcttagggcagccagagcagactaacttaatagtcatgctcatttgtttacttattgtctttggttacctttgcaatacaacagtagagttgagtagttgtgacagatgcctaaactattttactatgtgatccttaagagaaaaagtttgctaatccctgccctagaatattacccccaaaaaaggccattccaacctttctttaaatatctctaatgacaaaaaaacctctgcctcacaaaatagccttcccatttttgccaggcttggctattgtaaagactccctttacactgaatttgaaatatacttctccttaatatccaactaaagattttagctctgtcctttgagcacctcctaccaacgaagcaggctcctgtgttgttttctgttacttcttctttagtaggagaatcagctgttagtgacagcctctgacaggaaaacaaataatgcaatcctcaaaggtcatcggcaaaattccccagtttctcttgctttgaacttggaaggttctcgagcaagtccgcactcctccagagcatcacccgttaacacccctgggaactactaaatgaaaaaactaaggttgtagaattaaaaacacagtatgaagatctacaagcctacaaagttatcaccagatatacttaataacatatttttcccctctcctcttctttcaaatagagtaaaccccttccttccagtagcacatggaaaagtaggtaatttaggttcacaaggcgcaaagtcttaaataaccagtagttttcctgatgttctttggtcactccttttcacttgctaaattaaatttataaattgcataatcctatttgtagttaagaagaactccatcttataaattaagccccatttctagaatacagcttcctatcatctctctcctagcattaataagtcaccatgtcttgaagaacacttatcatcaccagctctcctgaagtaaaatgcaagatcacttcaaaaatggatgaagtactgggggtgagggcaggaaagaaggattgctacatcttctagaatcccctacagagctcatccttccaatcacaccaccaagttctgcatcctctcttcactttgactaaacaactcagcacaaagaggacaggaattctttatcaaaacaggtgcaaaggcaatgctggcctgccctctccacaattcaaggccttgaggccctccctggcctgaaggcttattggtgtcctcgctgatgtcctaagcccaagcagaagagattatgttctacagtttgttcatataacctcaatcaggaaggcaacccagaggatggtagagaatgtggttctggccactaattcgctttaaggttttcccagagatgactcagtgagtgttctttaaaaaaagaaaaaaacaaagagcacaatgtgtctgacctggatgggaatttgtagaaaggtaaacagctacatagcctagattaatgtatactgctccttcgttcagagtatcacaagacaactctagctcatgtagatgtgtccagtacatcagccttcaaaatcttctcaaatacgccagcttcctcttatattctcatacagtctactcctttattaagatgtagttggaggggggacaaaaagccaaaaaaaaagaaaaaaagctttattcaattgtctaggagaaaaaggtataaggagagatatagaaagtagaaaaataagaggactcagttacattacttcaagtttgtcaaaaagtaacaggaagacatactcccaaactatacactgaaccttgctttaattgattgtaataaagactcaagtatcaatgttttcatctagtcatgtgatgtctagtttcaagaaaaactgggttgttccatacttataccctcattgggtggtaatgactattctaacttacaaacaaaggaaaagaaccacaaaatgttcgaggtagaagaaacttggagatgttctcatcactttgcagatgtttctgaggccctgactgcagcacttccctcttgagccagtggacaggccaagggtccaggtttcctaactctggtgctctcgactttccatgagcctctcgcagcgatgcctaccaaaaggaatgacactcacaggtacacaacgattgacatttgtatatgaataatgaggaaaagcaaaagcaaaggtactttttgcctttcagagtcctaaagccaaatgtcgaatatattcaatgtaaaacaaagcattctgggggcactgtaataataaaatgttagcctaagagggtctctgtaaaaaaagaatactgaaatgggcagggtgtagtggctcgtgcctatagtcccagcactttggtaggctgaggcaggaggatctcttgagcccaggtgtttgagaccagcctgggctacataatgagaccccatctctaaaaataattttaaaattagctgggtgtggtggcacgcctgtggtcccagctacttcagtggctgagatgagaggatcgcttgagcccaggaggtcaaggctaatgtgagctgagattgctccactacactccagcctgtgcaacagcatgagactttgtctcaaagtaaaaaaagaaaggacactgaaatctacaaacatagagaatatgtctgaccctctgctaaacgtgtatttatatgatgccacagttcctgtacttatcaaaatactgtctttgtaacctaaactagctgaaaaggcactaaaatagttatgtgagcatttgtgtcaagcaaatgaaatctatttcttgaataactactgtctgtaaaaccttgacaggcattataaattatatcccaatccaaaaaggcaaatatgttgtctctaactctctgaacatatttagaaagataaaatatacccaagtgtcgcagttaagaatacaggatggcatcaggaaccataaggactagcagggcagtgaaagttcagaggcagggcacattcaagtcagcaagggatgaatctgcaaacactggtagatgaaaaagatgcttcatctcactggggggaaaacctattcaaagatagctgcctggattagctttgccctgctgagctcctcacagctcccccttttgcaggctctcttcttcctccatctttaatagagtatgaaaagctgcagggaaaggtagttatgtgcatttaaagaaacagcaatgacaccaaatgaaatgaacaagccatggaatttataaattcaaacattagatattttccggtactcctgccagaatcatgggacagacttaagcagctgcttttcaaagagctaaccattgcgttagccaaaaatgttggcccacagttagttaaaacagctgttttccctcttcttcaccaagcagcaagatctccttacctactcagcagtacaaaatccttgaaactgaaatcaaggcaaaagagacgcaaggcaaaatgtttcctagaacaaggataagttagtaagctccaaagaagaaaatttactcaagcaatgaggagactaatcacaggaaaaattattcaagcaacctaccctctctatgggtatttcaagcaaaatacccataaagttattttcaaggattattttatggaaaaaataatttaaagatgaatgaaaaattgattccaaatgaatgcattaaaaaatgcatgcttatcaaataagcaagactgacaaatctttattttattttatttttttattattattatactttaagttttagggtacatgtgcacaatgtgcaggttagttacatatgtatacatgtgccatgctggtgcgctgcacccactaaacttgtcatctatcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacctgtgcatgtgtctttagagcagcatgatttatagtcctttggatatataccctgtaatgggatggctgggtcaaatggtatttctagttctagatccctgaggaatcgccacactgacttccacaatggttgaactagtttacagtcccaccaacagtgtaaaagtgttcctatttctccacaacctctccagcacctgttgtttcctgactttttaatgattgccattctaactggtgtgagatggtatctcattgtggttttgatttgcatttctctgatggccagtgatgatgagcattttttcatgttttttggctgcataaatgacttcttttgagaagtgtctgttcatgtcctttgcccactttttgatggggttgtttgtctttttcttgtaaatttgtttgagttcattgtagattctggatattagccctttgtcagacgagtaggttgtgaaaattttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattgaatagggaatcctttccccattgcttgtttttctcaggtttgtcaaagatcagatagttgtagatatacagcgttatttctgagggctctattctgttcccttgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaggaaagtcattggtagcttgatggggatggcattgaatctataaattaccttgggcagtatggccattttcacaatattgattcttcctacccatgagtatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggccctctgtttgtctgttattggtgtataagaatgcttgtgatttatatacattgattttgtatcctgagactttgctgacgttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggaatggtgagagatggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctatagagataatcatgtggtttttgtctttggttctgtttatatgatgtattacattgattgatttgcatatattgaaccagccttgcatcccagggatgaagcccacttgatcatggtggataagctttttgatgtgctgctggatccggtttgccagtattttattgaggatttttgcatcaatgttcatgaaggatatgggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcagctgtaaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctaacggtctatcaattttgttgatcctttcaaaaaaccagctcctggattcattaattttttgaagggttttttgtgtctctatttccttcagttctgctctgattttagttatttcttgccttctgctagctttcgaatgtgtttgctcttgcttttctaattcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaaaaacatctttatttctgccttcatttcgttatgtacccagtagtcattctggagcaggttgttcagtttccatgtagttgagcggttttgagtgagtttcttaattctgagttctagtttgattgcgctgtggtctgagagatagtttgttataatttatgttcttctacatttgctgaggagtgctttacttccaactatgtggtcaattttggaataggtgtgatgtggtgctgaaaaaaatgtatattctgttgatatagggtagagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgtggaatttatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgggagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagtctccatggtctttacattttggcatgattttgtagcagctggtaccggttgttcctttccatgttgagtgcttccttcaggagctcttttagggcaggcctggtggtgacaaaatctctcagcatttgcttgtctgtaaaggattttatttctcctacacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggcaaagttctcctggataatatcctgcagagtgttttccaacttggttccattctccccgtcactttcaggtacaccagtcagacgtagatttggtcttttcacatagtcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcgagccttggttttcagctccatcagctcctttaagcacttctctgtattggttattctagttatacattcgtctaaattcttttcaaagtttttaacttctttgcctttggtttgaatttcctcctgtagctcgtagtttgatcgcctgaagccttcttctctcaacttgtcaaagtcattctccgtccagctttgttccattactggtgaggagctgcgttcctttggaggaggagaggtgctctgctttttagagtttccagtttttctgctctgttttttcccaatctttgcggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtagaaaccactatttttaaggactaagaatacagaaaagaaacatagatatatacatatatataagtaaatgaattcacaagaatttcacgttaatttttaaatgtttaatagccttctttctgtcatacacaagttagggaactatggttggtcctttgatcttcaggagtaaactcactaattttaagtcaagatataaattgaacacttgaaaaagcacaaagatgacagtatctctttctagcctcaacagggggaaggcagaaagtgtcccatagacaaattagtttaggctttcatatcaagttagctgaagttactagactaaattagtttgttttaataactactttatccacttactgcatatacatatatataacagatgcccaatatagaaatttagaaaagacagttacacagaagaataaaatgcaaaccatttttaacactactacagagatagctactgtttgcattagttgttgtttgtttacttgtttgtttgtttttgagacagggtcttgctttgtcacccaggccagaatacagtggaataatcatagctcgctgcagccttgacctcccaggctcaagtaatcctcctgaaactgcctttgcaaagttataactgaggaaattatgacaatgaaagaaatcagacctaatctactccatcttgcttgtaacatttaagctgttcttattcattcctggcagtaggctgaactaactttgggaaggaattcagttcatggtttgactctgaaacaaaatggatagcagccctttcccgaaaagaccccttcttgcctggggacgagtctgcctttgcaggactaacaaattagctacaagattagaaattacagtttaggggtcatgcaacctctggctccaagagtctgaacctccccaaattgctcctggggataacatcactattgtaaaacctagatcagtgcttgagatattctgcagaccctgcactggatggatcagctgacaccacccagactggtaatctggctcaaccagttctgccatcccactcaggaaagaagacagcaagaaaaccttacttcgttccccctatgattccatctccaacctgatcaatcagcactccccactttgcaagcccctacccaccagattatctttaaaaactctgatcccacccagcatggtggctcacgcctgtaatcccagcactctgggaggctgaggcgggtggatcacaaggtcaggagatcaagaccatccccactaacacagtgaaaccccatctctaccaaaaatacaaaaaataagccaggcgtggtgtcgaacacctgtagtaccagctactcgggaggctaaggcaggagaatcacttgaacctgggaggcggaggttgcagtgagccaagatcgcgccactgcactccagcctgggtaacagagcaaaactctatctcgaaaaaaaaaaaccaaaaaatttgatcccaaatgctgaacgtctggggagactgatttgagtaataataaaactctggtttctcacacagccagctctgcctgaattactctttctccgttgcaattcccctgtcttgataaatcagctctgtctaggcagcaggcaaggtgaatttattgggcggttataatcccacctcagcctccgaatacttgggactacaggcatataccaccacacatggctaattttttttattttttgtagagacaatgtctgctcaggctggttcaaacttctggcctcaagtgatcctttgaacttggtctcccaaagtgctaaagattacaagcatgagccaccacgcccagccttgcattagttttgacccacctcatttcacacttaaattttaaaaatgaatacattttattttaaataaaaattatatgtacctttttttattatgaactaagcttttttaaaaattttcagtaactctcacagtgcctgcctcatagtatataccaaataaatacataaaagtatccagaccacattagcttattcttttattatttttcaatgtttaaacgtctattgatatcagtgataactgctgtcttccagataaaaattgaaaaaaaaaattctggagaaactcctaaaggtagaactcttttaatgctctcatgagcttacactctaattttattacatcaaacaaccaaattgataactataaaattaattagaaatataggaattactgcttaacatgcacaaagcacatcttcttaacaggaaacatatatttctctatgttaagtacaaaatatattactgtcataatatttcaaaaatgagggaggagcttcaagatggctgactagcggcatctggtatttgccacctccacaaagaagaaccccttcagatagatcacctatcaaaaaacactgaaattcaacagagaagtgacagaaaacacctaaggtaaggaaggagagaaaaggaaggaaccctgcttagcagggaccagctgaaagcctggagaggctccccaatgctgggagaaggtaagtgagtggcctccagtggtctacattcccattatggactcctgcaatcctagccatgagagagcacctccaccctcgcagcccccaggactagtatagggagctacaagatatgcaatggcattgctccagagagggagctcctaagcggttaaagcaaggcaccattttgagagtctagccccgaatggactgcaggctgactttgggcttaatagcccctacatctccacattcctggagacttactgacatccccaagtgtagccaggcactgctgctggctgctgccaccaatgctgaagcaactccaccccctcaggagcagggctgctgcacatttcaaaacaccctgtggaagggctaccctgcttatctccactacctggagcgaaagtgcatgctctccagtcacctatagctactgccactgaaagcaaccccatcctccccaggagcagggcagcagcacagtcactactgcccccacccaagcattccaccagtggtctggatatcatcccatgcctgcctaccacagccagctcccacatgcaccactagaggggtctgaggacaggcctgccctggctctacactcccactcagtgcctgagcaaatggtctggaagcctggggatgaccctgccccatccaccactgttggtacctcagcactcctcccaggagcctgaggacaggcccactaaacctgcagctactaccacagctaacatctgcctgcatgtgccacctacgggcctggggactagtgtgcccagcctgttgcagccactgtcaacaccaatgcagacttcttggaaaccagaggattgtcctgccactgctactgccatttcccatgccatacctgctgtccaggggcctgaagacccagccatccagaccagtggtctaccactgccactgccagcacccaagcaggccagtcacctggaggcccaagattcatcatgcttggactcactaacaccagtgccagcatatactgcactgaagcccaaggacaggcacactcagcctgctgctgccaccagtgaagtccaaggactggccttcttgatgaccccatccccagcaaaacttcactacagcctccactaacaactataccctaagccactgaggaaatcacaaacaccactgatgctgtttacagctgaagaaatcaaacagaaactatactattgcaagcactcaaaatcaaagcaaaagtgccctacccaaacaataccacagatacatcttcaggaaaaattcctcccctataaaagagaattcaaaaaaattagaagaagtggttgttataccagatgcgtggatataaacatgaggacacaagaaacatgcaaaagcaaggaaatatgacactttcaaaggaacacaataattatccaacaacagattccaataaaatgtatgaaatcccatataaagaattcaaaataaggaaattaaagacattcattgagatgcaagataactcagaaaaaaaaagaaatcagaaaaacaattcagagtatcaataagaaatttacaaaacagacagatataataaaaaagaaccaaacataaattctggaactgaagaatctagttattcaacaataactagagaaagcagaagaaagaatttcagaacttgaggacagatttttggaagtaaaccagtcaaacaaaacttttttaaaagaataaaaaagattgacaaaagactacatgacatatggaataccataaagtgactaaatattctaattttcagtgtgccagaaagcaaacagaaaattacaaagagagaaaacctatttaacaaaataatagctgaaaacttcccaagtctggcaagagatttaatatctagataaaaaaatctcagagattcccaaacagatccattcaataaggccttctccatggcacattacagtcaaactgtcaaaagtcaaagacaaagagagaattctaaaatcagcaagagaaaagcacctagttacttataaggaaaccctcatcacactaacagcagatcagatttttcagcaaaaacgtcacaggccaggaaaaaatggaatgatatattcaaagtgttgaaagagaacagctcccagccaaggatgccatacccagcaaatttatccttcataaataaaggacaaatcatctttctaagacaagcaaaagctgagggaattcatcaccactagaccagacctacaagaaatggttaagggagttctacatatggaagcaaaaggacaatatctaccatcatgaagatacataaaagcataaaaccactggttgagtaaacacaaatgaggatcataaaggacccaaatgttaacactacagaaaaacaccaaaccacagtgataaacaataatagaaacaaaaaaaggtatacaaaacaaccagaagtcaattaataaaatgacaggaataagccctcatatatcaataataaccttgagggtaaatgaattaaactttccacttaaaagatataaattgactgacaggattttttaaaaacatgaccaaactatatgctgcctacaagtagctcaactcacccctaaagacatacatggactgaaagtaaaggaatggaaaaatatattccatgcaaatggaaataaaaatgagcaggcatagctatatcaacatcaaataaaacaaagtttaagtcaaaaaacagtaaaaacagacaaaaaaggtcactatatcatgataaaatgatcaaatccacaagagaatataataattctacatatatctgcacccaacttggagaacccagattcatgaagcaaatattaccaaatctaaagacagatagattccaatacaataatagtgggggatttcaacatcttactctcagcattacacagatcatctagacaaaaaattaacaaagaaacactgtatttaagctgtactttagaccaaatgaaactaatacacatttaaaaaatatattatagctacaaaatgcacattcttctcattagcacatagcatattctcaagaatagataatatgttaggcaaaaaaatgactcaacaagtttttaaaaattaaaatcatatcaagtatcttttcagaccacaacggaataaaactagaaatcaataacaagaggaactttgaaacctgcacaagcacatggaaattaaacaacatgctctgaaatgacaattgggtcaagaaagaaattaaggaggtaataaaaaaagtcttgaaacagataaaaattgaagcacaacatattaaaacctatggaatacagcaaaagcagtgctaagagggaagtttatagcaacagatacttacatccaaaaagtagaaagatttcaaataaacaacctaacaatgctcctcaaggaactagaaaaacaagaacaaactcaatccaaaattagaagaagaaaagtgataataatgatcagagcagaactcaatgaaatagagacaaaaaaaacagcaaaggatcaatgaaatgaaaagtttgttttttgaaaacaagattgataaacccctatgtagactaatcaaggagaagacccaaataaacaaaatcagaaagttgtactttagaccaaatgaacctaatacacgtttacaaaatatactaatattttgtatattattatatacaaaatatatatatgagaaatgagaaaggatacattacaactgatactacagaaacacaacagatcaccagagactattatgaacgactatacgctaacaaactgaaaaacatagagaaaataggtaaattcctggacacatacaacctgccaatactgactgacaaaaaaatagaggccaggcgcagtggctcatgtaattccaacactttgggaggccaaggcaggaggattgcttgagaacaggagttggaaaccagcctgggcaacatagcaaggccccgtcaggaaggaaaggaaaagaaaggaaaggagggagagagggaggaaaaaggaaaaggcaaggcaaggcagaaaaggaaaggaaaggaaaaaagaaaggaagaaagaaagaaagagagagagagaaagaaaagaaagaaaggaaggaaggaaggaaggaagaaaagaaaagaaaaagaaaggaaggaaggaaggaaggaaggaagaaaagaaaagaaaaagaaaggaaggaaggaagaaagaaagaaagaaaaaaaagaaagaaagaaagagaaagagagagagagaaaggaaggaaggaaggaaggaaatagtgaacctgaacgactaataataagtagcaagactgaatcagcaataaaatcttccaacagaaaaaaatccaggactggatgccttcactgccaaattttaccaaagttacaacgaagaactaataccaattccacacaaactattccaaaaattgaagaggagataattctctctaactcattctagaggtcagcatcacgctcatatcaaaaccacacagagaggcaacaagaaataaataaaaggaaagaaaagaaaactatagctcattatccctgattagcatggatccaaagatcctcaacaaaatcctagcaaaccaactccaacagtatatcaaaaagataatataccatgagcaagcagaatttatcccagggatgcaaggatcttacatttgtacaaatcaataaacgtgatacatcacatcaacagaatgaaagacagaaaacagatgatcatctcaacagatgcagaaaaagcatttaataaaattcaatatcccttcatgataaaaactatcaacaaattagtcatagaaggagcatacctcaacataataaaagccatatataaaaacccagagctaacatcacaccaaatgaggaggagctgaaagtctttcctctaagaactagaatgggaaaaagatgcccacgttcaccactcctatccaataaaatgctggaagtcctatccagggcaataaagcaagagaaaaacataaaaggtaccaaattggaaaagaggaagtaaaattattcctctttgcagatgacatgctcttacatctgcaaaaacttggaagattcataaaaaaattctaggtccgataaataaattcagcaaatttgtaggacacaaagtcaacatacaaaaattagtagtgtttctacacatcaatgatgaactagctgagaaagaaatcaagaaggcaatcccatttacaatagctacaaaaaataaaatacctaggaataaatgtaaccaaaaaggtgaaagacctctacaaggaaaactataaacgtctgatgaaataaattgaagaggtcacacaaacaaatcgaaaaacatcccatgctcatgggttggaagaattaatatcattaaaatgaccaccatactacccaaagcaatctacagagtcaatgcaatcactatcaaaataccaaagtcactttgtacagaaatagaaaaaaaatcctacagttcatatggaaccaaaaaagagctcaaacaaccaaagcaatcctgagtcaaaagaaggcatcacactacctgaaaacagacacataaaccaaaggaacagagtgtaaaccccagaaataaaccaacttattaataactaactgatttttcacaaaggcatcttggtcagagaacatgcattggagaaagaataccctcttcaatcctcttcaataaatggtgcggggaaaattggatatccataagcagaaaaatgaaactggactcttatctctcaccataaataaaaataaactcaagatggattaaagacttaaacataagacctgaaacgataaaactactagaagaaaacatacgagaagcatttcaagacatcgatctagacaaagatttttatagctaagacctcaaaagcaaagataacaaacataaacatagacaaatagtactatattaaactaaaaagcttcttcacagcaaaggaagcattcaacagaatgtagagacaacttgttgaatgggagaaaatatttgcagactattcatttgacaaggtactaatatctggaatacacaaggaactcaactgaacagtaaaaaagcaaataaccccatttaaaagtgggcaaaggacatgaatagacatttctctaaagaagacatacaaatggccaacaggtatatgcacaaatggtcaacatcactaatcatcagggaactgtaaatcaaaaccacaaatactatcttactccagttagaatgactattactgaaaagacaaaaaataatagatgctggagaggatgcagagaagaggaaacatttatacacggttgtgggaatatgagtgagtacagccacaatggaaatactatatttctcaagaaactaatagtagagtcattaccatacaatccaagaatcccactaataggtaactatccacagaaaaagaaatcagtataacaaaaagatacttgcaccccatgtttactgcagcactattcacaatagcaaagatatagaatcaacctaagtgtccatcaacagatgaatggctaaaaaagaataaaatcatgtcttccacagcaacatggatggaactggaggtcattatgttaagtgaaattagatagagaaagacaaattttgcatcttgccactcacatgtcagaggtaaaaatgttgatctcatggaggtagagagtgaaataatagagacgagaggctaggaggggtatatgagtggcagagaggaatgaagaaaggctgatgaatgggtacaagcatgcatttaaatagaaggaataagttctaatgtttgacagcataatagtgtgactatacttaacaacatgtatggtatatttcaaaatagctagaagagaggacttgaaatattcccaacatagagaaatgataaatactagaggtgatagatacccgaattaccttgacttgatcattacacattctatgcatgtaacaaaataccacacataccccataaatatgtacaaatattacgtgtcaatttaaaaaatgtatttaaccttcaccaatgtagttgagaggaggaactgtttacactgaatctaaattgaattttaagcatcatttaaattaattcatataaaattcactcagtcactagtgactaataaagtgaactctaataactcaggaagaaatgtttagtttcatattcaaattgtaaattaaaccagagcagtattattcaaatttttttcaggcatcagggtacccagagcttataatgcattttgcagaccacccaaaatactgattaagcttcaaaataaataaataactttttgctaaatcggaccactttttttttttttttttaacagcatctcgctccatcacccaggctggagtgcagtggtacaatcacaactcacagcagctctacctcctgagctcaagcgatcctgccacctcagcctctcgagtagctgggactacaggtgaacgccaccaggcctggctaatttttgtattttttgtattttttgtcagagataggattttgccatgttgtccaggtcggtctctaactcttaggctcagggaatccacccactttggcctcccaaagtgctggaattacaggcatgagccactgcgctcagctcagaccacttctcacaccagattctgttatttatacctgagaaaacgtatgggtggtagcatgggatgaagggagattaaaccattatttgattttagtagcgaaaatctttagttggattacacctcagaagaatagtttgggaagcactaaactagagaattataagcacagccacatttacatgtgcaatttaaattagatcttttaatgcctttttaaagtttaaaaatatcaacagcaccaaataacctcctcaaatctaagcatctatcatttgctttcatcttctgccttcagaaaatacagatttggctcaattgaatagcaagctaaggtcaccagggctctcaagataacagaactcttgaactgacacaccacattctttcttactgatttcatctagttaggcctccgtgtgattacactgagcattgcacgctctcatttaagatctcacttgcctccatcttcatccttcatttccctaacttctcaaatcctcactgatctttgattttctggctcttatcttggaaggttatttgttttgtttggtaattgtttgtatctcccctccccacacatgaagggatcagtgtacctactctatttcttttatcaaataaacacagcgctgagcaaagaaagcaacaaatatttaaccagcttttaacttatccactgacatctgtgagatttctgaggttctatttcaatgctccttgatattgaatagttgcttcaacttaaaaagtactatttttcaccttagaaatatttcttttggccaggcgcagtggcttacgcctgtaatcccagcactttgggaggctgaggcgggcagatcacctgaggtcaggagttcgagactggccaatatggagaaaccccatctctactaaaaatacaaaattagctgggcgtggtggcacatgcctgtaatcacagctactcaggaggctgaggcaggagaatcgcttgaacccgggaggcagaggctgcagtgagccaagattgtgccactgcactccaggctgggcaacaagagtgaaactccatctcaaaaaaaaaaaaaaaaaaagaaaagaaaagaaatctttcttttgccctgtttaccttccagtttatttttaactcttcacaaggctgttgtgtcagggcccttgtgtcagggccctcagagtagtgctccgggttatgaagaaaatgtacagagacagaaagccagtctaacggtgtgagcaaagcaagaatttgacactaaaagtgactacagaggcagcaaaaaggagcacagccagcaggcccagttctttcaagaaagaatacttatctcaggaaaacttggcgctgctcttccattttattttttcctttttctgtaaaatatgctaaaagatacctacctacatatctgctttatattgtcaattttcatgtaaaatcagtttgtacctattttttacttttataaattgattgtaccacaaagtttttaaaaattctaaatctctgaaaaacatacctctgtatttcaattataaacccaatttttataacaagaagactcaaaaagaaaaaaaaatcacatctttcagcttaccatatattggggaaaatgtgaagtagttcaggtgacaaatattataggcttcaattctaacatctttccagattccctgggtaggaaaggaaggcccccagtcccaactaaaggaacattgctcctgcaatttcaaggagaaaaagaagatatattctgattatggtgaaatttaaacattatgaaaaacattttctttaaaaatgttacatatgtgtatataagtttgctatggcagccataacaaagtatcacaaactaagtggtttaaacaatggaaatgtattttctcacagtgaagtccaagatcaagctatcagcaggtttggttcctcctgaagccgatctcctctgtttgcactgtgtcctcacatggtctttttctgtgctaggcatccctggtgtctctctccattgtccaaatgtccccttcttaaaaggacactagttgtattggaatagggcccacactaactgcctcattttatcttaatcaccccttaaagaccttctccaaatatgattacattctgagataccagaggttaggacttcaacatatgaatttggggggaccacaagttagtgcaaaactgtgtgtgccccccaaccaccatacacagcctctgaggtggcccacaatgatcccccctttgaagtgacctagtgaatcacttctaaccaccagcatatagcaaaaatgatgtgattttattaattaggttataagagactaagccttgaattttgggtactctctcatgccctctcttggccaagagggaagccagcctctgtgtcatggggcagctctgcggagagacccatatgggcaatctgaggtctgccaataactacaagtgagctcagaaacagactcttcagccttgagtcaacttgagccaagccttgagacaactgcagccatgagaccttaagccagaggcacccagctgagccacactcaactcagattcctaactaacagaagctatcataataaatgttttgtttatattattttttagaaatcagaaaacctatagtccacatattttctttttttaacttttaagttcaggggtacaagtgcaggtttgttatataggtaaacttgtgtcatgggggtttgtcatagagattatttcatcatccagctattaagcctagtacccattagttatttttcctgatcttctctctcctcccaccctccaccttctggcaggccccagggtgtgttgttcccctctatgtgtccatgtgttctcatcaataaatgttgttttaagctgataagttttggcataatttgttacatcacaatagataactgatacaatatccaatatatccaatatatctatgttgcacgtaacctatgaaacagataaatttggcagaaatgttctaagaacataaaatctatgaagagttgtacatttattcttcaaatgcttactacattgaagcaactcaatagttcctctttaaatttctctataatatctctgaacctaaccattgtatttaaatctaatagttacaaagaatattgtgcttacatgtaataattaaaaagaatgaggaggccgggcgcagtggctcacgcatgtaatatcaacactttgggaggccgaggcgggtggatcatctgaggttgggagttcaaggccagcctgaccaacatggagaaaccccgtctctactaaaaatacaaaattagttgggtgtggtggtatatgcctgtaatcccagctactcaagaggctcaggcaggagaatcgcttgaacccgggaggcggaggttatagtgagttgagatcgcaccactgcactccagcctgggcaacaagagtgaaactcagtctcaaaaaaaaaaaaaaaaaaaaaaaaagaatgaggaaacatattgaaagacaaacacttataaataggttttaaaaagctctggctaaacttgccaacctcaggtatgaattcagaagtccttgtttctgaacgtgaagcccaaaagcaatcagttcgatctttagcccctgaaacaggtggccaaggcagacattttatccaatcttatttgacctgggtacctgtctctcccttgatgacactcaacttccatattaagttacagagttcaaattcaaaaataagaaataattctgtaaaataaatccctttcacacagaatgttttctaatttctacttcttaaaagaaaaaaatattttcagaacagttaattaaaatgtgtaaagctataagttcagcttttaaaaaggaataagtttgggtcatacattttatggggggaaaaaaagtaacaagcaccagaggaaatactaaaatccttctagatggagtcatttgtgaaatagaacctgaagatttggccaaactgttgtcatttgggtattatttccttagctctgtactcacctaagatagagacaaatttgtttttactatggagaaaaacaaagaactaaagttactttatagcatccacatctgtctaaatttaccacttaagcaccagattctcatattcagaatgaaaaccatcttggggacatttatgggagaattttagtatctatttgtaattttttcattggagatagggaaaagaaggagagcaaaataatcaacatcttatgagggagactattttccccattaagagctacaaatcactcttaacctcttcaagaagtatttattaagtgccttctatgtttcaggctgggagtacttcaatatacacaacagacacagctcttctgcttataatgctcacagtcaagcacgaaattcaagcattgaataaataattacaagtataatgagttttacaatggaaataggcagggaacatacagtgagaggttgaggaggatgggtatcaagatgagttttcctgaaaaaaaaaaaaaagaccctgaagggtgagtaccgtttatccactgtgagcaggcaggaactttttttttttttttttgagatgtctcactctgtcacccaggctggagtatagtgacacaatcttggctcactgcagcctcaacctccaggctcctcccacctcagcctcctgagtggcagggactacaggctaatttttgtatttttttttagacttggggttttgtcatgttgtccaagctgatcttaagctcctgaactcaagtgatccacctgccttggcctgccaaagtgctgggattacagtcatgagtcactgtgccggcccagaagcattcctttcagaaggaacagcatgtgcaaaggtctggaggtgcaggacagtctgatgcattccagaagctgaagagagaacaatgggaagaggcagggagatgactggagaagtgagcatgggccagacagagctaagacccatggacactggcctaaaggcaatgagaagctgttgaagagtttgaagaaaagcagtgctgtgatcatttttttctgaaaagaccattctagctgctctgtaaatgattaactagaggaaggcaagtgaagtttcagggatgccagttaggcaaccagggcaatatttcatgcaaggcatgactgaactcaagacacagtggcagaaatgaaatgtgaacagactgaagagctattgaagaggtactattcacatcatcaagaggactaagcaatagattggaagagagaaaaaggagagaaaggtgtcaagaaaaactcaagtttctggcttgagcacctgttgtggatagtattccattcagcaagagacagaaccctgggagaaggacttaaatcacaagtgcggtgtggcgcatactgagctttaggtccctgtgaatcagacaagtgatgatgctaaataagcatctgaatgtaaggtctggaattgaagacaagttggacggaagacacaatattgggagacaatggcaaatagatttgttatggaagaaatgaaaaatgagatagcctagagagggtataaaatgagaaaagagtctagaacagagaaaggccctataatataacttttaggagaacaaggatgtggataaagagacttacaaggaacggccagagatgtaaacggaaaacaaggaagatggcatcaaacactggtaagagggtagcagaagtgatgagtcccactatccattctggacagaaaaggaagcagagacaataggggacttaggttgctacagggaaagtggaggttcaaagaactggtgaaagagaatatcaggggaaccagcccccaatatttcaacataggttcttttctattttccctaagtgtcagccagtctgagaaataaacagaaagagtacaaagagagaaattttacagctgggcctctggggatgacatcacatattggtaggaccgtgatgacgaccccaagccacaaaaccagcaagtttttattagggattttaacaggggagggggtgtacaaacagggagtaagtcacaaagatcacatgcttcaaagggcaataaagatcacaaggcaaggcaaaattagaattactgatgacggtctatgtcccgctgtgcaaacattgtcttgataagcatcttaacaggaaacagggttcgagagcagagaatcagtctgactagaatttaccaggctggaatttcccaatcctagtaagcctgagggtactgcaggagaccagggtgtatttcagtccttatctcaaccgcataagacagacactcccagggtggccgtctacagacctacccccaggaatgcattccttccccagggttactccttgctgggaaaagaattcagcgatatttctcctacttgcacatccgtttataggctttctgcaagaagataaatatggctctattctgcctgaccccacaggcagtcagatgttatggttatcttcccttcttccctgaaaatcgccgttattctgttctttttcagggtgcactgatcatattgttcaaacacacattttacaatcagatttcatattgttcaaacacacatgttctacaatcaatttgtacaatagtggtcctgaggtgatgtacagtctcagtttatgaagataacaggattaagagattaaagtaaagaccccactaacttcatataacctaagctgagcatcttgttcattacccgtaattatagtaataagcctccaaaatagatatcaccactctactttttgaatggttgtatagcactttacaacatgcaaagtgcatttacattgttatttcactatatcttcatatcagggattagctccatgtacaaatgacgggcatacctcaagttattctatgttcacaaagccagaattcagacccaagactcttcacttggtctccaactcaggtgtcttcccactggaccatgtcaatctagtcagaaatacctagatgcaacttgcaattgttctggaagcctacccagaggttagtgtccaaaacattgtgatagcagaaaactggatctgattcctgatgttagtgacaaagggctatgttctatctagataacttgagagtatgttttaaatgccacaaattgaatagagggtggagcaaaatagcatatggatatatgtataacatttatattatctttattgatgacttgaaaagtaacttttcacattaggatccaggatagtttcagttttgataaaggttaaaaatggaaggggaagccagcacagtagctcacgcctgtaatcccagcactttgggaggccaaggtgggtggatcacctgaggtcaggagttcatgagcagcctggccaacatggtgaaaccccatctctactaaaactacaaaaattagccgggcatggtggcaggcgcctgtagtcctagctacttgggaggctgaggcaaaagaatggcgtgaacccaggaggcggagcttgcagtgagctgagattgtgccactgcactccagcctgggcaacagagcaagactcagtctcaaaaaaaaaaaaatacaaaaattagccgggcatggtggcaggcgcctgtaatcccagctactcgggaggctgaggcaggagaatcacttgaacccgggaggcagaggttgcagtgagccgaggtcatgccactgcactccagcctgggcaacagagtcagacttcatctcaaaaaaaaaaaaggaaggggagagggaaaaagtacaacctctagcatttaaaccactgtgtcattggaagccaaaggcaaaagaatcaaaagataaatcttatccagacttataagcagacaaatattccatggaatacttgactactgaaaattgtcaaagcaatactctaaggctgttattacagtaatttgaacaaatggtcaatgggtcattgacacaagtttaggtaggttgaatcaaacaggaggaggtataattttaatcctagtacttatattaaggaaacataatttaatagtaaatcaatccagctgaaaaagagccatttaatttaatcagaacatattagctaatgtaacagttctacctaaagagtattgggaaaatatgtttagtatcttcacaatgagcccaatcattacatttgttgttaaaactaaatttcatggctcacgcctgtaatcccaacactttgggaggccgaggcgggtggatcacctgaggtcaggagttcaagagcagcctggccaacatggcgaaactccgtctctactaaaaattaaaaaattagccaagtgtggcagtgcatgcgtggaatcccagctactcagggggctgaggcaagagaattgttttaacacgggaggcggaggttgcagtgagccgagatctcgctactgcactctagcttgagcaacagagcaagactccatctcaaatacataaataaataaataaataaataaataaattcaatccatcaaaaaattaaaaatagaattaccatatgatccaaccatactatttctgggaatatatccaaaagaactgaaagaagggtcatgtaaagatatttgtacacccatgttcatagcagcattattcacaatagtcaaaaggtggaagcaacctaaacgtccgtcaacagatgaatggataaacaaaatgtggtatatgcatagaatggtatgttattcagccttaaaatgtaaagaaattctctcacatgctacaacatggatgaatcatgaggaaattatgctaagtgaaataagtcagtcacaaaaagacaaatactgtatgattccacttatataacatttctaggggaatcaaacacatagaaaagagtagaatgggccaagcatggtggctcacacctgtaatcccggcactttgggaggccaaagtgggcagattgcttgagccttagagttagagaccagcctgggcaacatggcaaaatcctgtctctacaaaaaaaatacaaaaattatctgggcatggtggtgttcgcctgtagtcctagctactcaagagacctaggtgggagcatcgcttgagcccagaaggtggaggctgcagtgagttgtgatcgcaccactgtactccagcctgggcgacagagtgtgacccagtctcaaaaaaaaaaaaaaaaaaagagaaagaaaagaaaagagtagaatgctggttgcaaggggctggggagaaggaaatggagagctattgtttaaacaataatgggtataatataatataatgggtaatgggtagagtttcagttttgcaaggtgagaaagctctgtggttacttaatgtaaatatacttaacactactaaactgtacacttaaaaattattaaagtgataaattttatgtacagtttatacaattaaaatttttaaaatatgaagtaaaatgaaataaacattaaaaaaccaaatgtcacatagaatactgattcaatcatgtagtaaaatagatccaagtcctcttagactggaatcatactctaagaaaaataattacttttgtggactttgttatctttttgttagattttatgagaacctgacagtaagatgcaagaacatatcatcaaatatactaatatttgcagagggcttcctagaaacaagaatcactaatacattttcacaatctggtgaaaagtttgataaacttaaatgttaaaaaaataatttgtaaagttccattatcagccacatatttttcctttctttttctgttacctaagttctgaacacgcttcaggaagaaaacttagaaaaagataaagattctccacaatatttcaaataatcttttggttcttatttcaaattttcaaaccccactaagggatcaggaaagagattcctaacttctgaaatgccatgggagtcttcaaataagcatttcatatgccagcacaccccgtcctcaaaaataaaacccgacctgtttgagagaccattaccttccgaacaaagttgacatggcattcacccttctgcacaagtggagggcagtctgggggaacctggtagcgagtgtgagctttgctctgctgtgctgcatacaacaccgctgactggaaacgcagctcaatggagttcacgtccctgaccacgttggtaatatcaaagctctaagttaaagggaacaatcagacaaacccatgatgtggaagtagtcttgtgtgtaaaattttagataaaggcattttgtatgaaagacacataatataatgccgatctaggtttagcctccttgcaggagggaacacttctctgaaacactgtagtatctatcacttagttgcccacttttagttaaaactaagcatattttcctacccaatccaagtttctaggcttctccttctatttttcctggcaaaatgatggtcctagggaaatggatagagcaaaaaataactttagctctggaatgtctgctctgtctacttatatgtggccttgaactgccaagggtttcctagacacttcatgacaacctgcctctccggtatgaacagcatgcatttctaagtaatgagttatttttgttttgaaaagtctacctttgaaaggaaaggaagatcagcatataatctcttaatataactattccagaaaggaaatgacattttattttaaaatcatttgtccaatgaaactgtatcagcagaggagggattggcatgttttgaacacttcctatgtgccaagaacttgccaacattttatacaattagcttactaaatccccacactaaccccatggggtttgtaaggtttccattattccacaaatgtggcaactgagaaatcaagtaactcatccagtgctttaatgagctcatatttgtcacatggccaattatgcatttacttttctctactcacaaaagcaattaacataaacacacataaattttttttaacctaatgtcattatatacttacatatctattgaacatattgtctgtttccccaatagtgacttcattgaacaggatttttgaaaccgtatccactccctcaagaatcaaatttactttttgccatttgctaaaaaaaagaaaagatttttaaaacaagatgtgtaaagcattaacttagataagtctcttttttattatttaaggcctaaagaaataaatattccacaaaaaatatatgttcttaaaaggcagtttccagtgacattttcagaagtactgctttaaaacatacttacgtcctttgagtgatccagcttatctttctctataatgtatcaataaatcaccataaaaccaagagcacaacttataatttccaaatatattgactttttctagttaatacttcagaaagctattatgagaaccaagttaggccaggagcagtggctcacgcctgtaatcccagcactttgggaagcctaggcaggcagatcacctgaggtcaggagttcgagaccatcctggccaacatggcgaaaccctgtctctactaaaattacaaaaaactagccaggcgtggtggcgggtgcctgtaatccaagctactagggaggctgaggcaggagaaacacttgaacccaggaggcggaggttgcagtgagtggatatcccaccactgcacttgcaagattccgtctcaaaaaaaaaaaaaaaatgagaaccaagttaaataatagacataaaatgttctcacaaactacatttactgaccctgtctaagagaacacgttagaaaactatcatctataagtgaatattatgcacccagcactctgctaagccttacaggaaactataacagtgcctgtacttaaggagtctgcaatctggttggcatttggtggctggctggcaatattgttgaacaactacaagtgctatcagagtttatctcataagaaaagatttcaaaatggaaacaagaacttaatgaagagaagaataaataaaatgtgttgtattcatacaataaaatactattcaacaataaaaaggaatgaagtactgatacatgctacaacatggatgaactttgaaaacattattatgctaagtgaaagaggcggtcacaaaggcccacatattgtatgattccatttatatgaggtatccagaacaaggaaatccagagggacagaaagtaaattagtggttcctagggctggggtaagaattcaggggcaggaggagtgggcaatgggaaatgactgctaatgggtgtaactttttgtggggggatgaggaaaatgttctaaaattgattgtggtgatggttttgtaactgtaagtatactaaaaaccattgaattatataccttaaatgactgaattgtacaatatgttaattatatatcaataaagtattttttttaaaactaggtagaaatgactgggtggaggcatttctactccccttataccctttgctctttgcaggaaccccttacccctgcaaagagcaaaaccaaaacaaggaagtgctgacagcatgaattacttttaggtaatcgactcatatgtgtaatttgggctggggagctaaggaggaaaaagctggacaaatccaaggggcagagaggtgcgggcagtgttacagggacagacatctttcagctgtattttcacagacaagtgagaagtttatacttgatttgccaagtaaaatagacacttgctattcttgaacgaatacctatcttggcacaatcaatattctgtgatgattaatctaatgtttctaaattgaaaagattggagaataaaagaacaaagcaagaaatttgattaggcagctttggcctctttcctggcactcttctaggcaaagatggaaagatggaaatgagatggaaggggccaaaccaagagaaatgttaaacaaaaatttgcaagacccacccagaacagactgaacacaggaagatgaagaaaagatgtaataagcccaaagcaccttagacatagactggaaaatggtgttacattaagaaaaacaatgaagctgttagaatataaagttagttttaagggggaaaatcaattggatatgttgagttcaaggtgaaatagaaccattacgaaagatattctaaatattatctgtaaataaaagcctggagcacagcagtaactccatgatattgataacaatattctggccttttcccccctttaaaagactagtaaataattaccaaaaaaaaaaatcacataaaagggacagaaggattttttttttcatttagcagtagtggtggtacctttgggtaacgttctacctcatatggaaatatttgcttataataacagaacattactgaaaacagtatctgtgcttcacctcctggcttcaccacatagtataggtcaaggtcatagtctcaatggctggttagcactacatagggcataaccactggaaaaatgactccataagacacaatttggtgactgttgattagtagcaccatcctcatatacaaaacaaaacataaataatatattcacttttatagtacaaggctttcatcttacttaactctcagatatgtaacctaaacaaacaaaacaaaacaaaacatacaaaacaaaaaaaaaacaaacaaaacacaacatttttgcccagatagaaaaagaagaaaagttcaaataataataaaaatacacccacaaacatacatacctaatttcaaaggggattttaaattctttgctataggtccagttatccaaagagacccatctgtagttaaggtcattaaatctgtagtaagaatcctgttgatacaaggtaaaaattatggtagatggttaaatatgcacaaataaattaataaaacaaacataaaataaattattaacaacagctatttatcacctaaaaattaacgaacttttagcctagtagtacaaagaggggacagatcgttaatactgaaaaatgtgaagggaaaattccaacaaattacctgaaatgaaataatcctctgagatataaataatacagcttcattatcaaagaaaattggtgggcattaagattggcttccccttggagacagggtttcaccatgttggccaagctggtctcaaactcctgacctcaagtgatccacctacctcagcctcccaaagtgctaggattacaggcatgagccatcatgtccggcctacagtttatcttgtgtactaacctgtttcactctctaaatgagcaaagtgggagatcactgtcacggctgaagttacatggccaagacaaactatggtctgggagtcccaggttctcctgtgtgggcactttcctggaagatgctaaatgataggaaaatctgggtttcatgtttctgtgtggtcctcacctcacttgacttctgctctttctgtttgctctgggcttccgtgctctcattgatatagttctcagttttccattggtctgtatcccattctgccttggacatctttacttcttgctgctcactgatgaatcaggaggcctgtcctggagatgagcttggtataggccaattgcacatgggtctcagagcactccatcttcaaggtccagataacatgagaaatgagtcttctcacatcattattggggatgaggggccgtagctgctggtttagctgaatttcaaactgatcacctggggacgagagcaatgggtaattgaagcttttgggctcgggagacaggccagtgcccatgttgttgtattcccattgtgtttcacagtcttctctaagttgaacgcagtctcagcagaatctccctcaggaggatggttgtaggttgtgttttcagagatggtgccttctggcatagtagtgttttccataaaaatgttttgttcaaaggcatttcttgcagtggtgcttttaaaacattctgatggagaaatacttccggaaaaggattttcctgaagactcaggtctcctaaagatgaaaaagccccttgtgaaggggcatttatgaggcttttcactgcagagaatggaggcctctttgcaagcaaagtctactgagagaacttttctggaatgtacgattggttttaactcaactttgcattttctaaaaccaaaatgggtaagtctttcaatctgtttctgaccacaggtagggcttttgcaggggtggagatagaaggcacgcccatggagaagggtttcagcaaagagaagactgctgccttatgctcttggttgaacgaaggcttggtatagatggcgtttcctgctaacttctcatgcccctgctctatgtgaggctgttccagctcccttggggctggactcctgagccttttttctttggcagcattctccacaaatgcccaggcaccctgttccttcctgttgctctgctttcccacctctttgaagtgacttttctggatgctccttgggcccatgaggattctgttcactctctgcaggcttttgcctacactttgaatcttagccaggctgttttcctgtggttggacagtttctaatttcatgagtttttggatgcagattgaagagagggactctttgtatggtttttcggaatacccatctttcacatttgaaaaaaacaggtaactataaggttagctgttggcagagctagcagaggttttattttggaccaaaaaaaaaaagcaattgaattgttttgtagctgaaggcataggcatggggggtccccaggtagtaaactaccctgtgggtgggttgagggctagggctgggcctcaggtgggtctcacgttccctgtgctcccttctgctctctgggagagtcgcaggaggggcaggctgggaggggctgccgcagctgttcacttgggcaggacgtcagaggactaggacaccagcctcccatcatgggtctcgatcttcttcacaaccactgccctggtggtgctggtgcggctgaaggagctggagcccacaccagagccaaagctggggcttgggaggcccccacaggccgagctcagatcacctgcataaccactggtggtctttgtatggatactcatgttctgcatcccagagtccagctggctctcctcgccctccagcagcttcctgtaggtggctatctcgatgtccagggccagcttgatgttcatcagttcctggtactcaagcagttgccatgccatgtcctgcttggcctgctgcagggcggcctccagcttggacagcttggcgttggcatccttaacagccagccccctgtgctgcagacatctgtgatggtgccctccagggaagccctctggcctttgaggccctcagtctcagcctggagctggctgatgttccggttcatctcagaaatctcagtctttgtacactgcaggtcatcctcgtgcttcccagccagcatctgcagctcctcatccttgatctggtacatgctctcagccttggcctggctgcagttggcgatctcctcgtatggtgccttgacctcagcgatgatgctgttcatgcccagggagcggctgttgtccatgggcagcaccacagatgtgtccgagatctgggactgcagctcctggatctcctcttcatacagctgcttgaggaaattgatctcgtcagtcagcccttccaggtgagactccagctctaccttgttcatgtaaccttcatccacatcctcttgatgaggacaaattcattctccacctctgtacacttattgatctcatcctcatacttgttcttgaagtcctccaccagcccgggcatgttgccaagctccgcctccagcttcagcttctcctggcccagagtcttcagctgctgcctaaggttgttgatgtagctctggaacatgttgtccatgttgctctgagccatcttctgctgctgcaggaggctccacttagtctccagcatcttgttctactgctccaggaaccataccttgtctatgaaggaggcaaacttgttgttgagggtcttgatctgctgcttctcctgggtgcgcacagcctggatgttggggtccacctccaggttaagggggctcagcaggctctggttgactgtgatggtggtgatgccacccacgctgctgccctcaccatagcctccgcccagacaaccttggaagctgctgctgcccactagggagaagcctgaggagcttatctggacactgggcccacttgtgtaggagtggctgctgaaggcccggggcccagaggtggacaccttgtaggacttctgggtcaccctgatggacatggtggaggcaggagtgggggcaggaaggccgaaccagatagagatcccagaaggagtggagaagctgcttcttggtcttttcagttaactttaccacatatcgtctcatgaccggaggaatttacaagagggtataacttagatttatccacatttctcatgaccttccctgtgccacctggagggctgtaagcagggtttgcttagtgtagcaagtcggcaaccttgctgtggcacctagataagggttcaggaatgcagctgcagagtattcggggtaagggtcagctgcactgcgggggcggttcctggggcagctcgtccctaacagtaacaacattgattctacatcttatagatttttctatgagaaataaggcaagacgtaatttagtgcgtcattgatgtctagctgctcactcccaaagcctgacaagttgatgccattgctgtctgaggccgcctccagctcagtagtcagctcagtgctcgtgtgcttcttccgggcttgtaataccttcatgaacgctccttctggattccctacagatagatgcttcttcaactgtcaggtaagacacaataagtctttctgagtttctcttatagggtttagcttgttaatttccttatcctttgtcctcaaactcaactatcttgttcttccttgcgcctagttaccataaacagcctacccgcttcccgtcagctctaatcaataactcacatctgttcccttggttacctgcaccccatgttcccctgaaactgcacatctcacacgctccacctctgtccccctccccttctatatttaaaaaaatatgtacaagtagccaattgggtcagctcaaactgtgcagtccaaccccagcccaagggggagtagcacagagatagggactgcgttgaggataaaaaccccctggtctcctttgttctctgtgctcttgcgatcttgattgacgcaagtggcacccttctgcagaagtaaattgccttgctgaaagaattaaaaaaaaaaaaaagattggcttccccttttaaaaccaaacacaaaaccaccagtatcagcagagaatgaaagactgaatctgtggtgtgtagccagcagtctctcattgccctgtggttctcactgtgctgtttgcgccactatcccagccagcctccagggggaatacttctctactgcccaaaagtcagcacaactcccttccgctcattggattcacttagcatttccagttatttttcacttagctaagtgagcatgaaaaggatctctacagagaatacacaggcagcagagatacttcaaaacttattaacatcaggtttcttatattatcctacctcaggtcagcaaactgccacccacaggccacattcagctcactacatgtctctgtgtggctagcaagctaagtaagaatggacatgtgcccataaataaagttttactagagcacagccatgccctttcctttgcaatttacatatggctgctttggtgctatagtggcagagttgagtagacatgatggagaccatctggccctcgaggtctaaaatatttagtatttagctatttactgaacgtgtttgctaacccctgcccaagatgactggcctcctagatgttcatagatgttgctccatctgagtgtctagacccaagtctgcctcttcataaatccttaagtctttcttctcctaccccctttccactctttttacacttttttttttgagatggagtttcactcttgttgcccaggctggagtgtaatggcgcaatcccagctcactgcaacttcagcctcccaggttcaagcgattctcctgcctcagcttcccaagtagctgggattacaggcatgcaccaccacacctggctaattttttgtgtgtttttagtagacatgggttttcaccatgttggtcaggctggtctcgaactcctgacctcaggtgatctgcctgtctcagcctcccaaagtgctgggattacagacatgagccaccgcatctggactctttccactctttatctcccagaggaatactcaagacaggaggcagaacagaaagtggcaaacaaatcttttcagttcatctatccatgaacaatatatagaagggaattgtgcaggcatggaggggcttcccctcctttgtcagggacagatccaagttatttccttagggaccgtaactccaagtcaagaaggaaaagccaactctgtctaagttccacacaggtaagagccagatgaacacgttaggctggcaatggccagttaggcagttgcccagggcaaatctgtaagaagcactacaacatcagtgggagtgtatcaagatcaagataggtatctgccagaaactgatccaaactggaagaaatattttgataagctactagaggagagagtgactgatgagatttaaaacaacacgtaatcaccaaactggcttttaaggtctggttaatggtaaggttttgttctgttaaatgccgtgtgccaagcccagccaacttatctcccacacaggactcggcctctccaatgaacaaacatggaacacatatttacagacacagggttgaagaggcacctaattattagcatgaccatgtcactcccccaagacctatttataactctacactgtggacttagtccaatacagttaaaaatatcatgagaaggaaggtgtgagagcaattcagccacaacacatcaacacactaagcccgggggctggctgatgatctggttgacggggcacaagtccccttcctttctcccagctccctgaaggaatctgcaagttggttcaagagggcaatcttcccagatatattttttcgacacaaacataatttataggttaaaattttatcttaaagaggccaatctgaaaaacctaaataatgtatgatttcaactatatgtcattctggatgttaaataaaaattacaggaggccgttgttgactgagctcctatactaggcctcagcagaccagatcaaaccaaaacagtcactcatgctaagtaccacttaatcaaactgaaactttaacgaaggaggtagatccgcaaacagggcagtttttcctgaaaacttgagattcctgttcacctgagtaaggaagtcctctctgcattttttttttttttttttgaaacaggtcttgctctgctctgtcacccaggctggagtgcagtggcacaaccatggttcactacagcctcaacctccggggctcaagcaaccctcccagctcagcctcctgaggagctggggctacagatgtatgccaccactcccagctaattttttatttttatttttttgtagagatggagatcttactatgttgccaaggctggtctcaaaatccttagctctagcaatcctcctaccttggcctcccaaaatgctgagattacaggcgtaagccaccacactggccggttctctctgcttttaccctttctagaaaagtaacctgaagtaatctgatgttaatcaatcagtttttttcctactgttctgtttctttgttccttacaaaacccactattcttccatggccccatgaaagtgctcactgtattttgtagaatggatgctttcctgattcatgaatcacaaataaaaaacaatttgatctttaactacatttgttgtaattttgtcttttgacatggaaaagaaaaaactatggagacagtgaaaggatcagtggttaccataggttaagcagaggagaagaatgaataaacagagcacagagaatgtttatggcacggaaattattctttacaatattgcaatggtgaatacaagtcattatacatttgtccaaacccacagcatgtacaaccaagaatgaaccctaatgtaaagtgtggactttgactgataaagatgtgtcaatgtctgttcattgattctaacaaatgtaccactctggtggggaatgttgaagaatgggatgctgtgcatgcaaggaggtaggaggttatgtgagaaccctctgtactttctgttcaattttgctgtaaacctacaaagtctactcttccgggggagaagggcagcagcgtgagagttggctctgaagagtggtgagtcagaagagacctcaggcagcaagcgacttgggccatggcctctgacctagacttctcacctctggaggtgcctgagcccactttcctggagaacctgctatggtacggactcttcctgggagccatcttccagctcatctgtgtgctggccatcatcatacccattcccaagttccacgaggtggaggctgaaccatctgagctcagaagtgctgaggtgacgaggaagcccaaggctactgttccttctgtgaacaagaggcccaagaaagagaccaagaagaagcggtagaagaggaggcccgaggagccagacaggcagggagagggccttggggacagccctcctgggaatctatatcctgttccccctctccatcccaggttcagggtctgaggaggctgtgacaccctctgacctcagagatctagacagtcatgacagtccccaggctccagctgtgcagtccaccacttcctcttccttctgcttctgtgatggtttagagtcaaggggactgaaacacactgtgactgtattaggaggtttgtttagaagttgggtcagctcacagagtcacattttcttacttagtcatgtgtccagccttgagtcaccccctccttgtgagtttacattacattttggagtcattatctaatgctgacaagcccaccctctcccattatttgtgcactacagatctcctgctaatcagtcaccttttttgctgctgtgtagacagagccaggcctcacctgtttgtttaggccaaaacgccatggccatgcaatgttagtgatcccactagctgcgacagccaggcccagaaaatgcctgacatgagagccagcagacagcccaggccagggtaggcagtgcctgcttctgctctgtcaggtgcaagggatttggctgaaggcatgcatatttcctggacacaaacttcctgagcttctgaaatgggaggctcatcaatttcagaccaacctcttttcaacccttcaacccatcatagcacgttcaaggtgtgccttttacttccacctgtacatcccccattccttcaattctttcattccctaaccagagagagttcctgggggaaatgtggcgaataaactgcatgcatgctgaaaaaaaaaaaaaagaaagaaaagtctactaaaaatttttctcttactaagagaaaataccaaaaaaaaaaaaaaaagttatagaggcttaaattacatttaaaataactattccaaaggccaatcaaccaacctaatttggttccaggttggtctgaccctatttgatcatactgaaattctgagccttatttatagcaaacagcagctcagggttacctctcatgactaaggacccatgtcagcctgagttgttaagcaaacccatgaaccctaaaacaaataaaagtatcatttgtcaaccatttactatacatcagcctctaaagtaggcactcatacactcttatcttcataataaacacgtacagtaaataccatttaatagaggaagaaactaaagctccaaaaagtgaagtagctttcctgaggtgccacaactaagcagaagtatgtacactgaggaaagaaaccaatctagtctaacaccaaggtctgaattttttggactatactacaatgcctcatgctacatatacttacacgtttataccagctggtaactgcaacaacaataataatagttaaaagttactgcctgtgaccctagtggggtaggtactattatcatacccatttaccaacaaagactctaaagctcaactcaaatggctattaagtggtggaggactgactcagaaccaggaaagatggctccagggtccatatacttagtcattacctagtactaccattaacatcacaacaccaccaatagttacaatgtcagtgcttataaagcagcagccatgaaataaacatgccgtgtgtgcctcggctagtgatttataattgatacttaccatatttactatgtttactgtacatcaacaaaccatgtgtcatcagagcatgcaaatgacaatatcatcagtctcattttctcagtaagcttctggactccatcattatacctgattatagatacagagactacttaaccaggtatagcttttccactccccagttctgcttcagaccaatgtcagactttaccccagatacaattacttcgaatagaattaaatggagaaagttttttcaactatcttgtttacaggcgttgttttcttagacacttgggcaaaaataaataaatagatgttaagaaaacacttatcaaaaacaagcaaaatgtggattaggatacataattatctggcaaactgagataaaacggcagataggagacaggactaacatgcagctcccacttggatgaacagaacagcatgtggagactcacactgtgaatttttgctccaagaaccaccacaggaacataccgggaaaaccaaaagaattcaagaccctttgaaacaagtggtttgccactgcaaattctgtgaaacagccaaaaactgtgagttcccaaagtgtgagagggaaaaatgtctgcctccaaacacacatcccctctgggaacctgaaaattcagatcacgggagaaggatttaaccttacctagagctgaaatggatttcaggagccaagcaaaatataatagtaccgagaaaagaagcaccggaaagagcgagtccccagcttgagtccagggaagccattcctggcctatctcacagaggtctttggggaagggaaggcacccagcagaactggaggggagtcacagggtgaaggaagctcccggctgaactttgtaatattttcgacaagcatgaattttcctgagcagaatccaggagcttgggggtggtgaacaggaagaacagatatgagcacagccaaaggtgtgagcaggtggggaggggtgaggcctgagagccatgtttgctttctcagcagggaggcttatagcctggggcaagatctcagtcctgctcaccggctgcctggataggaactgatataaagtcagtgctgttgggggggcacagtaggagtgagactggccttgctggcttcatggaagatgggtaaggcctgtggtgttttttttgtttgtttgttttttttttgaaatggagtctcgctctgtcacccagactggagtgcagtggcacgatctctgctcactgcaagctccgcctcccgggttcacaccattctcctgcctcagcctcctgagtagctgggaccacaggcgcccgccaccacgcctggctaattttttgtatttttagtagagacagggtttcatcgtgttagccaggatggtctcgatctcctgacctcgtgatccgcccgcctcggcctcccaaactgctgggatgacaggcatgagcgactgcgcccggccgggtaaggcctgtcagtgctggcttttccctagcgaactgtatgatgcagcagaggcaatcataatccccctggcaacataattccattagcctgagaaccccatagtggccatggcaggccccacccaaaaagagtctgagctcagaccctaaccctgtcctcacctgatggattttctctaccagacctggtcgccaaagacaaatgacataaacccttgggacctctatggtcctgcccatcacctgagaaacccaagtactcatcctggccaatgtagggcaatattatatccccccttctgctactgcagctagtgctttcttgacagggccacctcctggctggagaccaatcaactcaaactgataaaagaacaaccctgctctaaagaagaaaacaactaattccactgcctaaagaagaaaacaactaattccactgcctgcaatatcctggttaaccagaagtactgagtctgttcacatgacaacttcactgctagcataaccagcatttgagaaagccagtgcactaaatgaagctacaaccaaggactcccactttactcccctgccacctccactggagcaggtgctggtatccatggctaggagacctgaacgtggatcacatcacaggactcttggcagacagtccccagcatcagcctgcaggccagtagctccgctgggtggctagactcacaagggcaataacaatcactgcagtctggctctcagaaatccccgtccctaggggaagggggagagcatctcatcaagggaataccccatgggacaaaacaatctaaacagtaacccttgagttccaaatctttccactgaaacagtctacccaaatgagaaggaaccagttaaagtaattctggtaatatgacaaaacaaggttctataacacccccaaaagatcacactagctctccagcaatggatcgaaccaagaagaaatctctgaactgccaaataaacaattcagaaggttgattatcgggttactcaaggaggcaccagagaaaggtgaaaaccaacttaaagaaatttaaaaaacaataaaggatatgaatgaaaaggtctccagagaaacagatatcataaagaaaaaacaatcacaacttctgaaaatgaaagacatacttagagaaatgcaaaatacactggaaagtttcaacaatagaatcgaacaagggaagaaaaaagataaatgaaacaaaaactggctcggtgaaaagataaatgaaattgatagaccactagtgagattaatcaagaagagagaagatacaaataagctcaattagaaatgaaatgggagatattacaattgataccacagaaatacaaaagatcattcatggctactatgaacatctttatgtgcacaaactaggaaacctagaggaaatggataaattcctgcaaatatacaatcttctcagattgaaacaggaagaaatagaaactctcaacagaccaataacaagtagtggtgttgaaagagtaatttaaaaattgctgaccaaaaaaaagtccaggaccagatggattcacagctgaattctatcagacattcaaagaaagattggtaccaatcctactgaaaatactccaaaaaatagagaaagagggaatcctccctaaataattatatgaagccagtactatcacctaccaaaaccagaaaaggacataacatacaaaaactacagaccaatatccctgatgagcatagctgcaaagagcctcaacaaaacactagctaaccaaatccaacaggataccaaaaagataatacaccatgatcaagtgggtttcataccagggatgcaggtacatatgcaagtcaataaatgtgatacaccacataaaaaagaattaaaaacaaaaatcatattatcaactcagcagatgcagaaaaagcatttgacagagtctagcatcctttatgattaaaatcctcagcaaaattggcatagaagggacataccttcaggaaataaaagtcatctgcaacagatccacagccaacattgtactgaacagggaaaagttgaaagtattccccctgagaactggaacaagacaaggatgcccactttcacaacttctctttgacataggactggaagacatggccagagcaatcagacaagagaaagaaataaagggcatccaaatcagtaaagaggaagtaaaaccgttgctgttcactgatgatatgatcatatacataggaaaccctaaagactcatccaaagagttcttaacctgataaataaattcagcaaagttttgggataccaaatcaacgtacacaaatcagtagcactcctatacaccaacagcgaccaagctgataatcaaatcaagaactcaaccccttttacaatagctgcaaaaaataaaataaaatacttaggaatatacctaaccaaggacatgaaagacctctacaaggaaaaccatgaaacactgctaaaagaagtcatagataacactaacaaatggaaacacatcccatgctcatgaatggataaaatcaatattgtgaaaatgaccatactgccaaaagcaatctacaaattcaactcaattcccatcaaaataccatcatcattcttcacagaactagcaaaagcaaacctaaaattcatataaaactcaaaaggagcctgcatagccaaagcaagactatgcaaaaagaacaaatcctgagatatcacattacctgacttcaaactatactataaggatatagtcacaaaaacagcatgctacaagtacaaaaacaggaacatagaccagtggaacagaatagagagcccagaaataaagtcaaatacttacagccaactgatctttgacaaatgaaagaaaaaaataaagtgaggaaaggacaccctattcaacaaatgatgctgggataattggcaagacacatgtagaagaatgaaactggatcctcatctctcaccttatataaataaatatcaacttgatagatcaaagtcttaaatctaagacctgaaaccattaaaaaaaaatctagaagataacatcagaaaaactcttctagacattggtttaggcaaagacttcctaagaacccaaaagcaaatgcaacaaaaacgaagataaatagatgggacctaactaacctaaaaagcttctgcacagaaaaagaaataatcagcagagtaaacagacaacacacagagtgggagaaaatcttcacaaactatgcagccgacaaaggactaatatccagaatctacaaggaactcaaacaaattagcaagaaaaatcaaataatcccatcaaaaagtgggctaaggacatgaatagacaattctcaaaagaagatatacaaatagcagaaaaaatttaaaaatgtttaacatcactatcagggaaatggaaatcaaaaccacaatgagatactcctttactcctgcaagaatggccataattaaaaaaacaaaaaataatagatgttggcatggatatggtgaaaaaggaccaattttacactgctggatggaatgtaaactagtacaactaaggaaaacagtatggagattccttaaagaactaaacgtagaactaccattgatccagcaatcccactactgggtacctactcagaggaaaagaagtgataatatgaaaaagacacttggatacacatgtttatagcaccacaattcgcaattgcaaaaatatgaaaccagcctaaatgcccatcaaccaacaagtagattttttaaatgtggtatatgttatacataatatggaatactactcagccacaaaaaggaacaaaataaagtagagttggagaccactattctaagtgaagtaactcaggaatggaaagccaagcattgtatgttctcacttataagtgggacctaagctatgaggatgcaaaaggcttaagaatgatatagtggactctggagacttgcagggaaggatgggaaggtgagggataaaagactacacattgggtgcactgtatactgcttgggtgatgggtgcaacaaaatctcagaaatcaccactgaagaacttcatgttaccaaacagcacctcaggaggtcatggtttttttcctggtaaagtgacccaaaccttcattcctgaagggtctgggccatttgtagtcctgcccagattgggctgttgtaatttcccattgaccttaatctcagggcatggtaatactatgagacaccccaagggatctcctgtattccacgcatactcttccttatctccattgtggagcagtagactgattttgtcttgatagtctgggtcaatcaccctagccaacactgtaactcccttcttagcccactgacttaaacttaggaggagcccgaagtgtccaggtggcaatcttaacttctagtttaatggaatcattgtgtctcctggtggcagcgtttctccctctggaactaagacttctagaccagcagaacgtaatgtcgcaggaacaggaagcaaaaattttgctagtggatcactaggggtgatggtgagtggtaccacttccacttccatcccttgcttcctggacctatgaatcttggctatgggagaaacagtaccatatattgaatgctgattcagagcatacatggtcttctggagaactttgccgcagccctgaaaagtattgtcacccagttggcattgtaattgtgactacagaaggccattccaccattctatcaatccagctgcttcaggatgataaggaacatggtaagaccagtgaattccatgagcacgagcccactgccacacttctttagctgtaaagtgagggccttggtcagaggcaatgctgtgtggattaccatgatggtggataaggcattatgtcagtccatgaatggtagtcttggcagaagcattgcgtgcaggataggcaaacccatatccagagtaagtgtccattccagtgagaacaaacctctgccctttccacgatagaagcagttcaatataatcaacctgccaccaggtagctggctgatcacccccaggaatggtgccatatcgtgggctcagtgtcggtctctgctgctggcaaattggacactcagcagtggccgtggccaggtcagccttgctgagtggaaatccatgttgctgagtccatgtgtaacccccatccctgccaccatggccactttgttcatgggcccattgggcaatgacagggatggctggggaaagaggctgagtgttgtccacagaacgagtcatcctattcacttgattattaaaatcctcctctgccaaggccacctgttggtgagtactcacatgggatacaaatatcttcatagtttttgaccattcagagaggtccacccacgtacctcttccccaaatttctttgtcacaattttccaatcatgcttcttccaagtcactgaccacccagccaaaccattggctacagcccatgaatcagtatataactgcacatctggccatttttctttccatgtaaagtgcacaaccaggtgcactgcttgaagtcccacccactgagaagatttcccttcactgctatccttcagggatgtcctagaaaggggctgtagtgctgcagctatccactttcgggtggtgcctgcatatcgtgcagaaccatctataaaccaggccctagtcttctcttcctctgtcaactgataatagggaactccccatgaggccattagtgcaggctgggggagagacggcagggtggcagaagtgagccacttctgcctttgagccacttcctcatgtaacttaactgtgccttcaggacctgctcgagcccaatcatgtatataccacttccatttgatgagggaatgctgctgtacacaacctactttatggctagatgggtcagaaagcacccacttcatgataggcagttcaggtcacacagtgacttgatgacccgtagtcaaaggtttggtttccaccaaagcccagtaacaggccaagagctgtctctcaaaaggagagtagttatctgcagaagatggcagggctttgctccaaaatcctagcagcctctgccatgattcagctatgagggcctcccagaggctccaaacaccatctctatctgccactgatacctcaagcacaattggatctgctgggtcatatggtccaagtggcagagcagcttgcacagcagcctggacctgttgcagaaccttctcctgttctggatcccactcaaaactggcagccttttgagtcacttgctaaatgtgtcagagtaacacaaccaaatgtggaatgtgttgcctccaaaatccaaataggcccacaggacgttgtgcctctttcttggttgtagaaggggccaaatgcagcaacttatccttcaccttagaaggaatatctcaataggccccataccactggacccctagaaattttactgaggtagaagttccctgaattttggttggatgcacatgtctcaccaataagtccagtgtgtttggtacttcttgctcactggatccaatcagcataatgtcatcaatgtaatggaccagtgtgataccttgtggaagcgaaagagatcaaagtctcttcgaacaagattatgacataaaaccagagagttgatatgtccctgaggtaggacagcaaaggtatattgctggccttgctagctgaaggcaaattgcttctggtgggccttatggacaggaatggggaaaaagacatttgccaaatcaatggctgcataccaggtaccaggagatgtgttaatttgctcaagcaatgaaaccacatgtggtacagcagctgcaattggagtcaccacttggttaagtttacaacaatccactgtcattctccaagatccttctgtcttctgcacaggtcaaataggagacttgaacagggatgtgatgggaatcaccacccttgagactttcaggtccttgatggtggcactaatctccacaatccctccatggatgtgatattgtttttgatttgctatttttctaggtaggggtagctctaatggtttccatttggcctttcccatcataataactctcaccctacaagtcagggagccagtgtgggggtttggctacctgctacgtatgtctatggcaattatgcattctggcactgggaaatgaccacagggtgggtccctggatttccttccaaggaaggaagtcagacctgtaagtcagacctgagctaaaactccattaattacctgatctccataagcctctacttcaactggaggaccacaatgacattttgggtcccttggtatcaatgtcagctcagagccagtgtccagtagtccccaaaatgtctgatcatttccctttcttcaatgcagttaccctggtaatagactgggggtctccttggggaaggatgggagaaatattaacagcataaatagtcactagcatagtggggtccttttcaaggggacccagcctccccttcattcaagggtttctgggcctataaattttgtggtggagtgactgttgttcccaccgttagatctgacatacagagaagagcaattacaggactcttcagagatgcagttgccgccatcacaaatccatttcgcaaagcgttggtcaagggtgtatcttctggaccctcccagctgggatgggtaggtccaaagtgaccaatccactccagcatccaatctccctaaacttttggatcccttcctctacattaaactgagagagatcaggcatttccagcttgctcacagtgggccatcttttatccatatttcagctaaccaagcaaataaactattagaaccattaaaaccttttttaactccctgagctgcaacatcaaaagcagaatctctacttagtgggttcaaatcaataagtccagcctgatccaactctatattccttccgccattatctcacacccttaatatccattcttatgactcttctccagatttctgcttatataaattagaaaactcaagcagttcttttctagtgtagcacatctcctcaagggtcactctgaacctcacctctaggggtctgctgggactttagtctaggtataggtctagaagcaaacaggggtgttgggggtggctcctgaggagaatcaacgttattttgcctggcaactgcctcagaggaggccatcactgttgcctccaggcagcgcatggtttatctcctcagacaaaggtggaaaggctgatggcagcatgtgttggggaggggatgttgccactactggggatgaagaagctgtttcttctggcaaaaaaggttcatcagagttaacaagctcagtgtccccagcttcattaggccctccaccacacatccccattccaagttgcagggtcccattcttttccagtcaatcccctcactttaacagtagacacctggaaaggctgtgcatgcacctttcgttgcaggtcagccactcacatgataagagcttgtgtctatttttccacaatttcagctctttctctataggagataagactcttacacagggtaatctagcaggtgtgaggctcagtactacttctgaagctgaaaatgaatccctgagctcatcatttttctttcatcactttgtccagtgaacgtaggagcaaccaaccagctttattatgttccttggttctccacatatggtcaaaggtattatgtttcaagtcactaaactccttgcctctcacgagcagtgaatcaggagtatcagatgcatttattttgcataactctctaaacagttcatgccaaggactatgggtgttctccatactattagaaatagaattcttaggccgggcactgtggctcacgactgtcatcccagcactttggcaggccaaggcgggagggtcatgaggtcaggagatcgagaccatcctggctaacatggtgaaaccccgtctctactaaaaatacaaaaaattagctgggcgtggtggcggtcgcctgtagtcccagatacttgggaggctgaggtggcagaatgccgtgaacccaggagtcagagcttgcagtgagcagagatcgcgccactgcactccagcgtgggtgacagagcgagactccatctcaaaaaaaaaaaaaaaagaaagaaaaagaacctttagcattttttggtctaatcacattaagcagccaactccagaaaccccaaaaccaataaaagaactccatccttaatattctgttcctctagaaccacttctggtaccaaaatctgtattagtcagggttctctagagggacagaactaatgggatatatatatatataaaggggagtttacgaaggagtattaactcacatgatcacaaggtcccataacacgccatctgcaagctgagaagcaaggaagccagtctgattcctaaaggtgaagaacttggagtctgatgtttgagggtaggaagcatccatcatgggagaaagatagaggctgggaggataagccactatagtcttttcatgttcttctgcctgctttttattctggctttgctggcagctgattagattgtgcccatccagattaaaggcaggtctgcctttcccagtccactgagtcaaatgttaatctcctttgacaacaccctcacagacacacccaggattagtacttcgtatctttcaatccaatcaagttgacactcagtattaaccatcacaatgtttcattcagaagctatagtctccaaacttcagtttctcctctgtcaaataggatcttcagctatgattcttacttcaaagggtacacaggtacaagagatccccagcccacgagtctggcaacatgttttggtcagccttaacattatctttttctaaaatccttaaattagtaaatattgcttcccatctaacatagctctaagtgaaaaaagttgcagtttaaggagagtcctaattttctgaccaaagagactaaaacttaaaagggaaaacaagacaaactatttgcttggcccactacaagtcccaggcattatgcaaggttttcaaggagacacagagacaagtgacacctgactgaagtgtagcggtggggttcccaggactggacctcatgaaaggttagaataaatgcctgcagacagattcctagctgataggaagagtcagaggagatcacacttgctcagggagtgaggctgggcagctacatggttccactgcctctgagatgaagccaggaggtgactggagctgacatgtggaagaggcagttggtgaaaccttttctgcatgggtttgatccccagcttaatcctaatacctgtgagtctttgtgaagctcaaaaaacatctctgtacacctgttttctcagttcttgaatggagatagtaatcatacctacatgcctcacaggatcagtacaaggagtgcatgagacaattatgaagagtgcttagaacagttcttggtacatagtgtgcactcaaaaatgatagctatcttttctattacatgtactgatctgaaatgatgtctaagatatattaagttaaagaaaaaggtcaatataaaactatatatatatatagaatgcaatcatctgtggggggaaaatacatgtatctatatatgatatctgtctgtatatgtttataacatctatggaagaatacacaagaaaccggttaatcatggttgtttctatagaagggaactggacctagaagacagggatgcttttcataacatagcctacctttaaaactgtttactattggccaggcaaggtggctcatgcctgtaatcccaacactttggggggccgaggtgggcggatcacaaggtcaggagttcgagaccagcctggccaacatgatgaaacaccatctctaataaaaatacaaaaattagccaggtgtggtggcaggcgcctgtaatcccggctactcgggaggctgaggcaggagaatcacttgaacccaggaagcagaggttgcagtgaggcgagatcgtgccattgcactccagcctgggtgacaaagcaagactccatctaaaaagaaaaaaaaaaacccatttgctatttatatcctttacctgtttctaaatgtcattaagattaatttatctctttttttaaaaaaaagaaaacaatgagctaggttgatagcggtagaaatgttaaggaatggttataagacagtatagatgggacttaaaagatccagtacctaacaacagacgtgagaaaaaaaaacaaaaaactgtaaccaagattctaggcttagtttcctgagaaaatacttatgcttttattataaataggtaaaataagagaaagtaagggttgggagaattgagagaagaaatatttggatatatggagtttcatatgccatgaagacattcaggtaggagagttgaacagaatttctagctggaaatcaagtgagatgtggtggttagacacaagcatttcagcaattgtggcacagaagtgatggctgaaacaaagagaattccaagagacggagaatacagaaagaagtgatatatgaattaaccctgagaaaatgtttacattttttgagagcttttagcaaatggggtgcttttagtggcatattttgaacaaaagtatattgtactcatgtctctattttcatcagacacatttaaattaaaataactgttccatttgtttactatttactgtttctgccaataggcagcgtgcaatggtgaaaagaacatcggggtttgaatccttgctccaccatccattatatgcatcatcttaggcaataactttgctgagcctcagtcactgtgaattattataccttttccagagggttgttgctgaaattatatgaacaagtgcacatgaaagggccaagaaaagtgcatcacacgtggaagacataaaataaatgttacatgaaaatgaattgtataggctgactacatgcattaatacttatacatgataaggaccagccaacgcttacctaaaaatttagctctcaggtggtcctttgattttcagttcggggccacgcaaagcaaatcctcccataccctaaatacacctcatgtggcatcaaacaagaaagtatatgtccaggtttaaggatcaggattttttaaactatctgttttttttaaatgagggcttaaaaaccttggacttctctcttcccagaaattgagcaacattattaattgatgactatttctgtttaaattaaatttcaaatgcagagtcattagctattttatctccttaatgtcacacctgatagaagcagtcaaacttttttttttaattttactttaagtcagtcaaacttttagaagaagacatacatatctttaaagggtcatttcctaaaaagcttttgagatcatttcacatcataaaatgatcacgtaaagccaaatatttccttagttttttttttatttaaaaaacattttttatcattctcagtattcaaacaaatatttcatccttacaagtcttaagatctctgtggaaggttagtataacaaccagaaaaccttctgttttgagaaaaaatgtatgtttagtcattttggattataataatgggactctcttctctgaaacacatcaaaaatatttcacaagtcataatggttctgtggttatgttgaagaaaaaggaactccctatcttttaaagacccatactgaaatgtttgtggatgaaataatgtgataactgggattactttataatactaagggcgccaggagcagcggttcacacctgtaatccctacactttgggaggccgaggtgggaatatcgcttgagcctgggagtttgagaccagcctgtgcaacatagggagactctgtctctacaaaaaagaaacaaattagctgggtatggtggtgtgtacctgtagtcctagctacttgggaggctgaggtgggaggatagcttgagtccaggaggttaagcctgcagtgagccatgaccacgccactgcacttcagcctgggtgacagagtaataccctatctcaaaaaacaaaaaaaatgataacaaaacaaaataataagggatggcatagtggatagagaagaaacaaaattagccacgaattgatcatgttgaagccaggtgatggatacatgaaatttcattttgcaagtatctctattttactatttgtttgaaattcacccaaagtttaacaaaattcacatagaaactgcttatttgctacttaaagaatacaaaagtagaatgtacactgatgcacatatattgttagaatgtacttatgagtgataacctgcagattggagactccatagacagactcatggctccttagaaagaatgattgtgggtggagcagacccaaggaggaaaagcagagtccaggcttagactgcagcttctcgcttacctgtgcagtctaattttgagcggcctctttgtagttaagagacaggagctcccattctctctctactaacccaaaagtcttgtgtgtactccttgccttggctcagctccaaacacatttctacaccgataacaagaaatatgctgtaaatgatgtttccttctcaatccctgccgcctctgaatttgctgaccttagtaacatcatcaataaattactaaaggacaaaaatgagttccacaaacatatggagttttatttccttattaagggccagtttctgcgaatgtccttggtcaaacacatggaactggagaacatgtcatcagaagtagttgtggaaatagaatatgtgaagtacacagcaccccagccagagcaatgcatgttccatgatgactggatcctttcagttaaaggggcaaaggaatggatcttgactggttcttatgataagacctctcaaatccggtccttggaaagaaagtcaataatgacaattgttggacatagggatgtcttaaaagatgtggcctgggccaaaaaaaaagatagtttgtcttgcttatttgtgagtgcctctatggatccaactattctcttatgggagtggaatagagagaaacaaagtgaaagcccgaccgtgctgcagaggtcatgctggaagtgcagagtctatagctgttgatagctcaggaactaaattttgtagtggctcctgggataagatgctaaagatctggtctacagtccctacagaagaagaagatgaaatggaggaatccacaaatcgacagagaacacagagcagctatgactcccatagtgaccctctctggtcacaaggaagcaatttcctcagttctgtggtcagatgctgaagaaatctgcagtgcatcttgggaccatacaattagagtgtaggatgttgagtctgacagtctgaaggcaagctttgacaggaaataaagtgcttaattgtatttcccattctccaactttgtaaacgtttagcatctggaagcacagataggcataccagactgtgggatccccgaactaaagaccattctttggtgtcactgtccctaacttcaaatacaggttgcgtgacattagtaaaatggtctcctacccatgaacagcaactgatttcaggatctttagataacattgtcaagttgtgggatacaagaagttgtatgatctggctgctcatgaagacaaagttctgagtgtagactggatagggacacagggctacttttcagtggacaagcagacaataaattgtattcctacagatattcacctaccactttccatgtgggggcatgaaagtgaatgataaattgatcatagagattctttatacaaatgaacttggtagaaaatcatgaaattatactgatgcagatgcagaaagcagccgtttgaaatttatataatgttttcactcttcataacagctaacatttaactatctttttcttattttgtatttataatagtttgtgtttataaaataaaaagaatgattgtgactagcttgttaatcacatgtatagctactatgatgtactcttacagtttatagttaattaacttacacatctaaaatatatctttctctggccatttgtcccaattgcatgtgaagaatataaggtaataataaaatttacggaaaaagtactaagtatctgttgcctaccactttttagtatatgtgtatatttatatacttataatttttattttcaagtgtagattttgaataagaacacatctttataatggggtgtatgaagctatttgcaataatcctggatctatatttacagacacagacaaatatattcatgatatgttttaaatgttaaagtagctaataaaaccaccttaggggatgatttcatttttatgttatatttgtctctatatacttagaaaaaaatgtggaaagataaacacttttttacagtggtctttttctgctttatattatgtgttttattggtttttcttccttctttatattttctgtatttcttttatccaatgaacactacataaatacgtatttttaaaagaattttaatcatgtaacctttctaaagattaaaagagaaggaataacaatattatatcagtatatgcgaatttagtgcatgataaaagtaatatatcagcggacaaaagagaaattcttcaaatcatgagttataggcaaccaattaactatttggaagaaacctcaaatgaatcaaaattttaaatataggaactataaagatagctgagaggaattatttttaagcaaactaccaaagacagaaacaatcataaaaggaaaacaaaagatttcaacatacacagctttaaaacatccatatgacaaaatacttcattaataaatgggacatttggggatttagttttaatttgaatttttgaaaatatataacaaaggggccttataaatctatattaaagaggccacccatggtggctcacacctgtaatcccagcactttgacaggccgaggtgggcggattgcctgagctcaggagatcgagaccagcttgagcaacacggtgagaccatgagaatcgcttgaacctgggaggcagagaatgcagtgagcaagatgatgccacttcactccaacctgggcgacagagtgagactctgtctcaaaaaaaaaaaaaagaaaaaaaaaatcaccattaaagataaatagccaaaagaagatgaattagaaatgcccatgtcaccaataaacttatgaaataaacgtataaaggtatttgaccttactagaaaataaattgattttgttttgtttcttaaataatattcaaatctagcacctaagataagcactctgataaaataatggtggcagtgtacaactggtacaatgtttatgaaaagcaacttagaagcacgtactaaatgactaataaaagtacatatcctatgaatcagctatttaacttttaaatatttgtctaagaaaataaagatgtacagtaaaatttagttaaaaggatcctcatcagaaaaatagaaaaaaatggagtccaatctaactatccaacaataagtaacagattataactgatggtaattgtatataacataatttttaaaaagccactaaacatggtttatagaaacctgtttaatgcaggtaagagcatcacaatacattaaatgtgaaagagttgttatttattttattttatttatttatttttttttttgagatgtagtcttgctctgtcacccaggctggagtgcagtggcgtgatcttggctcattgcaagctccacctcccgggttcatgccattcttctgcctcagcctcccgagtagctgggactacaggtgctggccaccacgccggactaattttttgtatttttagtagagacggggtttcaccgtattagccaggatggtctcgatctcccgacctcgtgatctgccgccttggcctcccaaagtgctggaattacaggcgtgagccactgtgcctgcccaagagttgttaagctgtatatttaatacttataaaagtgtatgcattaaaaaaattagaatggatgcactgaatttttactttaatagtggttatcctgctcaatgaaataaaagagaacacaaacaaatgcaagaacattccatgctcatggataggaagaattaatatcatgaaaatggccatactgcccaaggtgatttatagattcaacgccatccccatcaagctaccaatgactttcttcacagaattggaaaaaactactttaaagttcatatggaacccaaaaaaagcccacattgccaagacactcctaagccaaaagaacaaagctggaggcatcacgttacctgacttcaaactatactacaaggctacagtaaccaaaacagcatggtactggtaccaaaatagagatatagaccaatggaacagaacagagccctcagaaataataccacacatctacaaccatctgatctttgacaaagctgacaaaaacaagaaatagggaaaggattccctatttaataaatggtgctgggaaaactggctagccaaatgtagaaagctgaaactggattccttccttataccttatacaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaacttgacaaatgggatctaattaaactagagagcttctgcacagcaaaagaaactaccatcagagtgaacaggcaacctacagaataggagaaaatttttacaatctatccatctgacaaagggctaattaatccacaatctacaaagaacttcaacaaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcagtaaacaacaggtgctggagaggatgtggagaaataggaacacttttacactgttggtgggactataaactatttcaaccattgtggaagacagtgtggcaattcctcaaggatttagaactagaaataccatttgacccagccatcccatcactgggtatatacccaaagtattataaatcatgctactataaagacacatgcacatgtatgtttactgcagcactattcacaatagcaaagacttgtaaccaacccaaatgtccaacaatgatagactggattaagaaaatgtggcacatatacaccatggaataccttgcagccataaaaaaggatgagttcatgtcctttgtagggacatggatgaagctgcaaaccatcattctgagcaaactatcacaaggacagaaaaccaaacaccacatgctctcattcatagtgggaattgaacaatgagaacacttgggcacaggatggggaacatcacacactgggacctgtcatgaggttgggggctgggggagggatagcattaggagatatacctaatgtaaatgaggttaacgggtcaacgggtgcagcacaccaacatggcacatgtatacatatgtaacaaacctgcacgttgtgcacatgtaccctagaacttaaagtataacaaaaaaagggaaaaaataaaaaataaaaataaataaatatataaaactgttgggggcattagtcacatgaacagctgtcaaaaaaaatagtggttatctctgggagtgatgtttccaaccttcttcttacttatctatatattttaatgttggcatacagagactatctaaaaaaaaaaaaaaaaaaaaaaaaagaagcagttgcttcaaaacttacaccagtgagaaattccacagaaaagctgagaacattcctaacaagggtccctttatgtatgcacttaacataacatatggaaattatttagttttctgcctcactaaagtggcctcccacaaaataggaactatagtctcactctcaatttctttttttattcctaatgcctattacactgtgtggcataatagcaggctgagggccaggcacggtggctcatgcctgtaattccagcactttggaaggccgaggcaggtggatggcctgaggttgggagttcaagaccagcctgaccaacatggagaaagcttgtctctactaaaagtacaaaattagccaggcatggtggcacatgcctgtaatcccagctacctgggagactgaggcaggagaatctcttgaacccaggaggcagaggttgcggtgagccgagatagtaccattgcattccagcctgggcaacaagagcgaaactccgtctcaaaaaaaaaaaaatagcaggctgaaggaataacttttcacagagaacccaaaagactctctaagaaaccaaaggtttagattctgtacagaaaacccagagaatcacctaggaaatagccaagactagccacagaatctctcactaaatacaaatttcatttaaccagctcagataaaaaaaatcctggtattttcctgcacctcccccttctgtctcccaatccattaacaaatccaactgaagaaatcctcttgtttctacatgtaaaatgtgttctcacaaccattctcaccatttcactgccaccatgcttgtccaagccagaagtcatctcttgcccatacatagaccagcaatagtcccctggttggtctccaggcttccactctcctgcactgtagccttcacacaacagagtgacctttaaaaaggcaaatctaatcatgctactctaagctcaaagcctccaataacttcccatcacatgtagaataaaagccaaagtgtttcctatggctcacagcctttcatgatgtgccctagactttgaactcctctcctaccctctggttcccaggtctccagccacactggcctgctgactattcctgaaacttgtcaagctcgttcctgcctcagggcctctatcctccccactcctgtgtttttcctctttgctggaaatgcacttctccttaaaagtgaccttttcaaacaggtctttttgtttagaagtcaccttatcaaaatacctatcttgaaccactttttaaaaaatagcaatgctttccaaccagccttcactgtctcttcctttaacctgctcaatttttcttcagtgtgccacctgccttacattatttattaatttggtatatatgtctatctcctccattagaatgtccattagggaaaggactttgttttctttaccactcgatttcaagtacttagaatagtgcctgccacattagaggtacaaaataaatatgagataattaactaggtgaatagataaataaatgaatgatatcaccaagatatgtttcaagttcttacacaaacacaatatttggcccagtgtctactataaacggtagaatatttcctcaagtcaacaccaaaaagggatgttataataaagcaggtcggacaacagtctcacattactgaataacgatactgatctgatgttgatgattgcttctttactttttttcttttttttttttttttgagagagggtgtcactctgttgcccaggttggagtacagatcacggctcactgcagcctcaacctcctgggctcaaacgatcctcccacctcagcctccctcgtagctaggaccacaggtgtacgccaccacgcccagttaattttttaattttttgtagagacagggtctcgccagttgcccagactggtctaaactccacctacctctgcctcccaagtgctgggattataggcatgagccactgtgcccagcctgatgattattttcaacaggccttgtgtttcctaagccccaaaagccttcccatttctcattccactgccatttgagacccatggccacctgattgaaacctcaaggttttgctaagaatttatgaagagagttaagaaatctcttcaaattgttcctatgaggaagttatttcatactatgagcaaattcattttcattaagtatctgttgtaaccaaacgttgtttcttagcttcttagctctgtaatatggcacaataatctgacttactgaagccactcattatttcccattggcttaattctttctttcttttttttttttttttagagatagaatctctctatgttggccatgctggtcttgaactcttggcctcaagaaattttcccacctcggcctcatagactctttctatgttggccatgctggtcttgaactcctggactcaagggatcctcctaccttggcctcccaaagctctcacgtaccagcacccattggcttaattatttcagtaaaatcaggcaaggaggaaccctacaaaataaacacaggcattctcaaagcagatataagtgaaaactcagagtatactgtggtcagctgtgttctctatcacaagtagtttgtcaacttaaaataaagtactaaagtttgggaatgatctactctaaaaatacatcggacaatggtcaatgtcatttacaacattcacctcctttctgatacacatctcaggaaaaaaaaaaaaaaactactaagtaccaggtcagaaatttggcacaaccctagatgaccaccttgtcatgcaaataaacttagaatggtgctcctgaaagtcagccacagtgcttcaaaaacacatgattttttaaaacaccaaactaagcataccacatagtatagagaccaggctatggagttgagaccacctgggttagaattccatttctttccatttagttgctgtcaccttcctaatttctctgtgttccatagttccatattatccataaaattcagatatgaacacttactatacagagttgttatgaggattggacaatgtatgcatcccacaagtagatcaattacaagtacattttgccccaagtaaagacaacacgtgggaacgctgtgcaagagggaacagcaaaagcagttggaggatggaagtcagtttgcaaacctatgcgcacaggcagccaaacacgaaaacgttccccacaagtagtctgtaaattggagactccattgggatacacacacacacacacacacacacgccctgagaggaaatagcacctttcttcatcaccaagttagccttaaaaattatttacccgttgttagccacactagcactgacaaacccaactttactcttgtaggtcattctccacaacgtctgtgctgcgtcaatcccaaatctgactccctgacgcttaacagcgaaaataaaaaaccgagacattactcaatagagttaacccttacttaacaaaacgctgttgtcccctgtggcgtgcagacagtagagacagtaattcccgaccttatgcttgtcagtgacggcatgccctttgtatacacgcttcagtagagaacgactgcagtaagtaaactgctagtagcaacactgttcccctatctaaacttcccctttccagagttactgatgtcccaacatgggtcggtcgctcagtctccgtcaagcccgtaccccatagcttgggcatttccccccgcagatcacaagatgcaaaggggaagttactaccaaaccgacgagaatggcccagagctgggggctgccaggcggttcctgggcccctctcagcaccagaagaaggcgggcgcaggctcgccgcgggtcggccgcacgccatacctggatcaggccctgctggaacaaggcgctgtgcacgcagccagggaccgccccgggcagctccagcgagccgttcccattgcagatgctccagttgccacgcaagctgtaactgagctccgcggcggtggtgcctgcaccgcacagcgcgagcagcaggagcaggtggaggcgcatcttgagatcccgcgccaccgagatgtggagagatcgaaaggcagcgctgcaagggaccggcggtgaagccactcaccccctcggaagtagccgaggctttaggtccccgccccggccccgcccctaggtcagctgagcgctctccgggcgcagccgcgggcgggaggggaacgaggaggctgcgcctgcacccgctgaaagccgggcgtcgcgggtgcgggagctgcagcccccgagaatagctacaggctggggggcattgcggtctgagccttccctcggcgcttcttcccgccgcctcagtacatacaactggaggcaagaatcttgcacggtaattgggacagaaagatccctgggcgcgcagtggcacaaagcctcgggagatcagagaccgactgtacgtggagaccatagctggagagtcccctcactccttcagagaacccaaactgggagacaacccaccacttcccttccgccaaatttacacagaccctcgtctacctggtagcgtaacactcaccccgctgcagctcaactcgcgggtctcagagcctaccccgcccttcaaagagtaaacaagtactagcagtatctccatcagaaggttgttctgagggctaaccaagaaaatgcgactatagcatgcagcatggagcctggcccagagaaggcattcacgttagctattgttactagcggcctgcgtccttatgtttcataaagccccacggaggtttctgaggttctggaacttgcactaggcgcgcagctgagtttaaaatcctctgcactcactagctgtgggacctgggcaagccgcaaaatctccatctccgtttcttgaagttttcaaggtgttataagtataaaatgagtaaacatatgtgatcgtccctaacaatgccagagtacccaagaaataccactgacttatttcgggtcttgtagtcaaatggtctacctgagtcccatttttgcaataggatgtaacagtaatcctagaagttaagacggaattttacattgcataaaatagactgcctttctcctgtgttgacgctatctgccgtatatttatgcttcggaagaagtccttgaaaagaaattttctctcatcaaatctgagctttgtttcgccttacaatggccttggaattgcctgattctgcagacaccgggcaatatcttactttgcaaagtcagcattatttacaagccctgaatatcttggcttaaaggacagtatggattatccaacccaagccgctggctttacagatgagggaactgagttcaaagagatcggggccaggcgcggtggctcacgtctgtaatcccagcacttctgggaggccgaggcgggtggatcacttgaggtcaggagttcgaggccagcctggccaacatggtgaaaccctgtctctattaaaaatacaaaaattagctgggcgcgtggtggcacgtgcctgtagtcgcaggtgctcgggacactgaggcaggagaaccgcttgaacccaggaagcagaggttgcagtaagccgagatggcactactgcactccagcctgggctatagagaaagactctaaaaaaaaaaaaaaaaaaaaaaaaagatcaggtgacttgcctgtcacatagtggcagacaggattagaaccctcctcttcaaggtcctactgtcagagcccaatgatgctataggggaaacgctctcactgcttcaaagccttcctcactcactccagaagcatttttacctttgatagaaacaaagctctcaattcaaattatatgccataattcacggcattaaatggctagccatggtctgtgcaacactgataacacaaggtttatggcaacaagagcggcaaaggaattttttcataattcccagagatttcattaagccaaatcagaggaaaattcatccttgatgatacatatggatatattctgtttattaagaaatacttaagaaatataatttttagaaaaacaataatagaagattctcattcctcctttcattccaggatgcaagcataacatcatttaggttacttcactttgacaacagagaacatcaaagaataatcaaagccctaataagtactcttcctaaaattgcaattggcacagatgacatgatgttttcattttgttataggataatttttgtccatgattttctggtaaataaaccttatttagagataacataaaacttctcaacttatgtaatttaaagtcatgataccaaatgcaatgtttaaaatagttatgggtatctttaacttacactgtataaacagatttcattttgatcatttcatttgatgcttcccaaaacttgaattatttagaacaagtgatcgttccctggtttaaaaagataaataatgcccacggtgattaaatgatgtgtagggtcagtatcctgtcacaacagaccaatggaagtagttaggccctttgctatatgacaacatttccttcatatctaaatatataaaattggtaaactcattagaacaccatggtatataccaaggccaatgatattccaatcccatgatatattacagaagttataataagggaaagaaaatgaaagagtaatcagatgtggagtggacatttgcctttagactcatagtgtctgattaaaccccaggactggggataatagcccataagtatcctgcccaaaggtttgacatacttccccagagtttgaagccccaaatgttagaacaaagagagaaggtagtggaaactatgtacaccactagaatttggtgtgtcaaggatgcatatgcatgagtttcctataaaccaagaggacaccgtaggaagtaaccaggcttgagccagtataatgggattctacccaagagagtccaagaagtgaactagaggacacatggcctatgtcagcaaactgtgtatatatatacatatactgtatatatacatatatacatatacgtatatatatacatatactgtatatatacatacatacatatactgtatatatacatatatacatacatatacaaatatatattttaaatatatataatttatataataatataaatatataaaaatatataatataattatataatataatataattatataattaggaatataatatattatattcctaaataatgcatgggtcaaaacaataatagatttccaatttctggcctggcatgtaaggaccttggaagtcatcactctatcctaaaaagcaagtaaaaagctgcacaaattgaaaatagacaactcttcttagatgagtcaaagaagtgaggtcacagggcagactgctgcccccaaaattagagatgtagacaggtagatacaggcaattacaacttaactgagtagaccacacacactaccccacaaccattgtcccatagctgaaatctcagtgggaaccagtacagagtaggaagacctggactataattgacaaattactggaggaccaatatgcacaaatttgagagttaaaaactccaagggggcccagtcttaggggagcagctgtgcttttgtaagtttgcctccaggagctccacaaagctctcatagtgaagattgaagaaaaatcctctcgtgtttcctgcaagggaggaggaaagtaactattctgaatgtgccagagattctgtgcttcttaacaagacccactctcaaaagaaacaattttaccagagctgaaccaactggggttttatcagagtctcgccagcctgggagaaggaaaatacccaactccagccccccatagacattctgccccatctaagggggtgaaacatagctgagaagcactgtgaagttcacagtccaggggactgggctcactagatgactgagacctaatcagaggaaaatagaccattttccctctcccaacaccttcccaacacatcactgaaggcctatttatggcaattcctttcacccaggatgtcatgtatggctttcaacaaaaatttacaaagccaaagatacaacttggaaagacaaagcaaatgccaaaaccaaactcacatatgggaggaatgtcagaattatcagtccaggaatttaaaataactatgattaatatgctgagagctctaatggaaaatttacacaacatacaaaaacagatgggtaacgtaagcagagacatggaaattctaaaaaataataaaaaatgctagagatgaaaagcaccataacagaaatgaagaatggcgtattagtagatggaacacggctgagaaaagaatctctgagcttgagggtatgtcaacagaaactttcaaaaccaaaaagcagagaaaaatgtatgcaagaaatgaacagaatatccaagaactgggggacaactacaaaagatattgtcaatgaaaagagtcaaactctataaatatttgaagagatttattctgagccaaatatgaatgaccaatggcctgagacacagccccaggagatcctgagagcatgtgcccaaggttgcccaaggctacacagcttggttttatttattttagggagacataagacatcaatcaatacatgtaagatgtacattggtttggtccagaaaggtaagaaaatttgaagtgggggcttccaggtcatagatggattcaagaattttgttcatcagcaatcggttgaaggagttaagttattgtctaaaaatctataattaataaagggtaatgtctgggttaagataagaggttgtggagaccaaggttctcattatgcagacagaatcaatagaagggactgtttcttatctgacttaaagagttttctatgagtcttaagttctctgttttaatgttaatgctggcaggtatgcctgaattccaaaggaagaggggtataatgaggcatgtctgacccccacttccatcagggcctgaactagcttttcaggttaactttggaatgcccttggctgaggggagggtccatcagtcaattgcatggctaagaattttatttttggtttacaatataatatacatgaatagagactactagacggagaagacagaaaggaacagaagacacatttgaagtaataatgactgagaatttccccaaaattaatgtcagacacaaagtcacaggtccaggaagttccaggtacatcagcaggataagtgcccaaaaaactacacctgggcatatcatattcaaatcaaagatttaaaaaaatcttgaaagaggccagagggaaaaaagcaacttacctatagaggagcaaagataagaattatatccaacttctcctcagaagccatgcaaacaagatgagagtagagtaagatatttaaagacttgcaaggaaaaagtgcaccaacctacaattctgtgctctgcagaattatttctcaaaagtgaaggagaattaaagactttctcagacaaacaaaaatttaaataatttattgccagtagatctgccttgagaagaatgttaaaagaagttcttccaagagaagaaaaataatatagaaaattagaaaatcagatccacatgaagaaaagaagagcattagagaaggaataagtgaaggtcaaacaaaaactcttatttttgccaaggcatgctggttcatgcctgtaaccccaacacttcgggaggccaaagcaggaggatcatttgaagccaggagtttgagaccaacctaggcaacaaaacaagaccctgtctctacaaaaaaaaaaagaaagaaagaaagaaagaaagaaaagaaaaaggaacttttattcttcttatcatttattgacctaacctataacagcatgctcaaaatagtaatagcaacaatgtgtttaattatcaaatctatgtataagtgaaatgaatgatagcaataacacaaggggtatgagacaaaaattaggaatattttattattataaagtaatgaagcagtacagcgctatttaaaagcagatttacgctgggcgcggtggctcgtgcctgtaatcccagcactttgggaggctgaggcaggtggatcacctgaggtcaggagttcaagaccatcctggccaacatggtgtttagtctctactaaacatacaaaattagtaaagcgtggcagcatgtgcctgtaatcccagctgcacaggaggctgaggcaggagaattgcttaaactcgggaggcggaggttgcagtgagctgagatagcgccattgcactccagcctgggcaaaaagaacgaaattccgtctcaataaataaataaataaatgctgatttacagccaggtgcagtggcccatgtataaataaacaaacaaataaataaataaaagcggatttagggccaggtgcagtggcccatgcctgtaatcccaacattttgggaagctgagctgggaggactacttgagcctaggagttcaagaccatcttgggcaacaacgtgagaccccatctctacaaaaaatagaaattaaaaaaattagctaggcatggtggtgcgtgcttgtggtcccagctactggggaggctgaggagggaggatagcccaggagattgaggctgtagtgagccatgattgtgccattgcactctggcctggatgacagagtgacaccctgtctcaaaacaaaaaattaaaattaaaattaattaattaaaaagtagacttgaccatactgcccaaagcaatctgcaaattcaatgctattcctatcagattaccaacttcatttttcacagaataagaaaaaatgattctaaaactcatatgaggccaggcacaatggctcacacctgtaatcccagcactttgggagactgaggcaggcagatctcctgaggtcaggagttcgagaccagcctgaccaacatggagaaaccctgtctctactaaaaatacaaaattagccaggtgtggtggcacatgcctgtaatcccagttactcaggaggctgtggcaggagaattgcttgaacccaggaggcagaggttgcggtgagctgagatcacgccattgcactccagcctgggcaacaagagtgaaactatgtctcaaaaaataaaataaggccaggcgtggtggctcacacctgtaatcccagcactttgggaggccgaggtgggcggatcacaaggtcaggagatcgagaccatcctggctaattcggtgaaaccctgtctctactgaaaatacaaaacaaaaaagaagtagctgggcgtggtggcacgctcctgtagtcccagctactcgggaggctgaggcaggagaatggcatgaacccgggaggtggagcttgcagtgagccaagatcatgccactgccactgcactccagcctgggcaatggagcaagactccgtctcgaaaaataaataaataaataataaaataaaataaaacccaaaaaagtacctgaatagccaaggcaatcctaacccaaaagaacaaagccagaggtataacagtacctgacttcaagctatactaaaaggctacaataaacaaaacagcagggtactggtacaaaaatagacacatagaccaatggaacagaatagagacccctgaaagccacacacctacaaacaactgatctttaacaaaattgacaaagctaaataacgaggagaggacacccaattcaataaatgttgctaggaaaattggctaactatatgcagatgaatgaaactgtacccacacttcccattacatataaaaattaactcgagatggaataaagacttaaatgtaagacctcaaactataaaaattctagaagaggccaggcgtggtggctcatgcctataatctcagcactttggaggccagggcaggtggaatgcttgagcccaggagtttgagaccaccctgggcaacatggtgagacctcatgtctattaaaaaaaatgctagaagaaggcctagaaaatactcttctagacattgatcctggcaaataatctatatgatgaagaccccaaaagcaaatgcaacaaaattaaaaaatagacaaattagacttaattaaaatgaagaacttcagcaaaagaaactctcaacagactaaacaaatagcctacagaattagaaaaaaatttgcaaactatatctctgaaaaggactaatatcagagtctataaggaatttaaacaaatcaacaagaaaacaaaaaaccccattaaaaagtgggcaaagaacatggacaggcacttctcaaaagaagttataaaagtggccaagaaacatgaaaaaatgctgaacataactaatcaccagaaagatgtaaatcaaagccacaatgagataccatctcacaccaaccagagtggctattattaaaaagtcaaaaaaataacagatgttggtgaggaggcagagaaaaggcaatgcttatatactgttggagggattgcaaattagtgcagcctctgtggaaagctgtttggagatgtatcaaagaactaaaaacagaactaccatttgacccaataattccattactgagtatatacccaaaggaaaataaagttttctaccaaaaagacacatgcactcatgtattcattccagcactattcacaatagcaaagacatggaatcaatgcccatcaacatcaacagtggttaccaacagtggattggataaagaaaatgtggtacataaggctgggtgctatggctcacgcctgtgaccccagcactttgggaggccgaggcgggttgatcgcttgagctcaggagtttgagaccagcctggggaacatggtaaaacccaatctctaccaaaaaaaaaaattgtttttaattagctgggcatgctggtgtgtgcctgtagtcccagctacttgagaggctgaggtgggcagatcgcttgagcctgggtggcagaagttgcagtgaaccaagatcatgtcactacactccagcctgggtgacagagtaagaccctgtctcaaaaaaagaaaatgtgacatatactccatggaatactatgcagccataaaaaaaatgaactcatgtcctttgcagcacttggatacagttggaggcagttactctaagtgaattcatgcagaaacagaaaaccaaatgttacatgttctcacttataagtgggagctaagtcttgagttcacacagacattaagatgggaataatagacaatgcagactccaaaatgagggaagaagggagggtatcaacggttgaaaaacttcctattggatacactgctcactatctgggtgatgggatcaatagaagcccaaacctcaacatcacacaatatacccttgtaacaaacctgcacatatacctcctgaatctaaaataaaagtgaaaaaatgtgtttaagtgaacttggagtcactctaaatgtatactgcaaactctagggcaaccagtgaaaaaaaaatttaaaggaatgcaactgatgtgctaagaaatatgattatataaaatgttcagttaaaaccacaaaaggcagaggaagagtggaagacaaagatagaacaaagaacaagggcaacaaacagaaaagagtaacagggtgatggttgcaccaaaatctcagaaatcactgctagagaacttatccatgtaaccaaaaatcacctgttccccaaaaagtattgaaataaaaagacagtaacaaatgtggttattgtcagatgttatagatattaatccaactctatcaatggtctaaatacaccagttaaaggacaattgtcggagtagatgaaaacaataagacccagctatatgttgtctataagtgacctattttcattataaagacacatctagattaaaacttaaaagaaggacaaagatataccacacttacattaattttttaaaaagtgagtagctatattaatttcagagaaagcacacttcagagcaaagaaaattatcaggatacagagggacattacataatgataagtgggtcagttctcccaaaagaccttacaatccataatgtgtatgtgcttaattaataacagaacatcaaaatacattaatcaaaaacagagagaactgtaagaagagaaagataaatctactaatatatttggatacttcagcagccctccatcagtaatagagagatctagcaggcaaaaaaatcagtaaggacaaagttgaactcaacaataccatcaatcaactgggtatagttgacagctgtagaccatttcatccaacaacaacagaatacacattcttctgtaggtcacatagaacattcactgagatagaccacactttgggccataaattacaccttaacaaatttaaaagaatataaattacaaaatgtggaattaaactagaaagcaataacagaatgaaagctggaaaacctcaaaatactggatgattaaacagcacaattccaaataacacacaagtcaacaaagaaatctcaagataaattaaaacatttttaatacattaattaaaaaacaattttatcaaaatgtgtgggacccgcaaagcagtgcttagaaatttacagcattaaagtcatgtattaggaaaaaagaaagatctaaaatcagtaatcaaaacattcaccttgggaagctagaaaagaccaattaaatccaaagtaagcagaaggaaaggaacgataaaaattaaagcagaaataatgaaatttttcaaggaaatcagggaggagggggtaagaaaaaaatatgaatgcatttattactactgacttttacacttaaaaatggtaaagatggtaaattacatatgtatattttacctcaataaaaatttttacaagaaaataggaaatcaatagagaaaatcaacaaaaccaaatgctggttttttttaaaagatcagtaaaattgataagcctctagccaggctaagaaaataagagagaagacacaaattattcatataacaaatgaaagagggaacatcattacagatcccaatcagacattaaaatgataaaaaagaaatactatgagcaaatttatgttcacacatttgatagcatagatgaaatagccaattccttgaaagatacaatctgctgaaaacttacacaagaagaaatagacaatcttaataggcctatatctattaaagaaattgagtcaataatcaataatcttgcaaaacagaaagcaccaggccagatggtttgctagacaattctaccaaacatttaaggaagaaattataccaattctctacaatttcttccagaagacagaagcagagggaatatttgctaactcattctatggggccaatattaccctcatattataaaacaaagacattacatgaaaataaaactacagccgggcacagtggctcacgcctgtaatcccaacactttggaaggccgaggcgggcagatcacgaggtcaggagactgagactatcctggctaacacggtgaaaccccgtctctactaaaaatacaaagaaattagccgggcgtggtggcgggcacctgtggtcccagctagttgggaggctgaggcaggagaatggcgtgaacccgggaggtggagcttgcagtgagccgagatcgcgccactgcactacagcctgggcgaaagaacgagactccatctcaaaaaaaaaaaaaaaaaaaaagaaaacaaaacaaaaccacagactcacccagagcaatatctctcatgaacatacatgaaaaatttctcaacaaaaaattagcaaattgaatccaacaatatataaaaagaattatacactatgaccaagtgggattcattctgggtatacaaggctagttcaacatctgaaaatcaactcatcacaccaacaggctaaagaagaaaaaaaacacatgatcatatcaatagatgaagaaaataaagaaaaagcatttgacaaaatccaacagccattcatgacaaaaactctcagcaaactagaaatggaagtgaacctcctcaacttgattataagaagtaaaataaaaaaactacaactaacatcatatttaatggcgagaagctagaaaactttattgctaagatcacaaacagggcaagatgtgtcctatcacaactccttttcaccatcgtactggaaaccctagctaatgcacaaagactaggaaaggaaatacagtcatgtgccacttgacaacttttcagtcaatgacagattacatatacaacggtggttccataaaattgcaatggggaagaaaaactcctattgcctagtgaggttgtagcgactgtaatgtcatagtgcaacacattactcatgtttatggtgatgctggtgtaaacaaacctactgtgctgccatgcatataaaagtatagcactcagttatatacagtgcataatacttactaataaatgactatgctattggtttatgtatttgctatactatactttttatcattattttacggtgtactacttctatttactttttttttttttttttttttgagatggagtattgctttgtcgcccaggctggagtgcagtggggtgatcttggctcactgcaagctctgcctcccgagttcacgccattctcccgcctcagcctcccaagtagctgggactacaggcgcccgccaccacacccgcctaattttttgtattttttttagtagagacagggtttcaccgtgttagccaggatggtctcgatctcctgaccttgtgatccgcccgcctcggcctccaaaagtgctgggattacaggcgtgagccaccgcgcccagcctctacttacttttttaaagaaagttaactataaaacagtctcaggcaggtccttcaggaggtattccagaagaaggcattgttatcacaggagatgacagctccaggtgtgttattgcacttgaagaccttacagtggaacaagatgtggaggtgggagacagtgatatcgatgatcctggccctatgtagaactagaactatgcagaactaactatgtaggttaatgcttgtgtttgtgtcttagttttaaataacatctttaaaaagaaaaaataaaacaaaaatttaaaaaaatagaaaatatcgtatagaatatgagtttaaagaaaatatttttgtatagctatacagtgtgtttgtgttttaagctaattgttatttacaagagagttaacaagttgaaaaattaaaacatttataaagttaaaatgttacagtaagctaaggttaatttattattgaagaaacaaaaaatatttttcataaatttaatataccctaagtctacagtgtttatgggcgacaggtatccaaaatatacaaagaacacttaaaactaagccataagaaaatgaacaaaaaaatctcaacagacacctcactaaagaagatatacaggtggcaaataattatataaaaataagcatacaccataagagaaattgcaaatgaaaacaaaatgagataccactacatacctattagaatggccattatcccaaaggctgtcaacagcaaatgctggtgaggatgtggaggaacagaaactgtcattcattgctggtgggaatgccaaatgataaagccacttcggaagacagtttggcacttctttacaaaacctaagcatactcttagcacatgtgatcattagttttatgtatcaacttgactcggtcatgggttgaccagatatttagtcaaacattattctgggtgtttctgtgaaggtgttttgggatgagggtactatttaagttggtagaccaagtaaagcagattgccctccgtaatgtggataggcctcatccaatcagttgaagacctgaatagagcaaaagattgaccctctctgaaggaagagacaactcttctgcctgacaggcttcagactggaatactgtctcttcctggttctacagcagcctgccagcctttggactcaaactggaacattagctctacagattttggacttaccacctctgtaattgtgtgagctaatttcttataataaatctctttataatgtatatacatcctactggttctgtttctctggagaatcttgactaatatgccatatgatccagtatttggattccttggtatttacacaaaggagctgaaaatatatatccatccaaaaacctgcacatggatgtttataagagctttagccataattgccaaaatctggaagcaaccaagatttccttcagtaggtgaatggataaaccaggtgtctggtacatccagacaatggaatattattcagcacttaaaaaatgggctcagtcgctcacacctgtaatcccagcactttgggagtctgagacaggcagatcacctgaggtcaggagtttgagaccaatctgaccaacatagcgaaacctcatctctactaaaaatacaaaaattagccaggtgtggtgatgcatgctgtaatcccagctacttggaaggatgagacagaagaattgcttgaacccgggagacgaaggttgcagtgagccgagattgcgccactgcactccagactgggtgacagagcaagactccatctcaaaaaaaaaaaaaaaaaaaaaaaaaagagggctatccaggcgtggtggcccatgcctgtagttgcagctactttggaagctgaggcgggagaattgcttgaacctgggaggcagaggttgcagtgacccaagattgcaccactacactccggctttaagtgcatattactaagtgaaagcagcctatctgaaagtctacatactgtatgattccaactatatgacaatctgggaaaggcaaaactatgggagacaataaaaacatcagtagttgccaaaaattgcagggaggaagggatgaacaggtggagcacagaggatttttagggaagtgaaaatactctgtgatactagaatggtggatacatgtcattataatttgtccaaatccatagaatgtaaaacaccaagagagaaatctaatgttaactatggactttgggtgataatgatacatcaatgcaggttcataaattgtaacacatgtattactctgctaaggatgttgattaagaagcaggcggtgggggagcagagtctgcatgtgctgagcagggtgtgtactggaattatgtactatccactcagttttgctgggaatctaagattgctctataaagtttttttttaaatgagcaaatgatttggataaatatttatccaaagaaaacatatacatggctactaagcacataaaaagatgctcaacattattagttattaggctccttggtccattcaggctgctataacaaaataccataaactggatagcttataaacaaaagaaatttatttctcacagttctggagtgtgggaagtctaagatcaaggcaccagcagattcagtgggtggtgagagcccactttctgcttcatcgatggcaccttcttatggtgtcctcacatgatggaggggacaaaggagcacttctcaggcttcctttataagggcgctattaccattcatagggtagagccctcataacctaatcatatctcaaaggctttccaacccctaataataccaccttaggtattagaatttcaacatattaatattggggtcagggagtgggagcagatcataacattagggaaatgccaatcaaaaccacaatgacataccatttcacacccactaggatggctataataaaaaatatggtcaataacaggtgtttgcgaggatgtagaaaaactagaattcttgtacatcactggtagaaatgtaaaatggtatggcttttgtgcaaaagaggttggtggttcctcaaaaaattaaatgtggagttactatatgacccagaactttcaatcctacatatatacccaaaagaattaaacatataggctcacacaacaagttgcgcacagatcttcacagcagtattatttataatagccaaaaagtagaaacagcccaaatgtctattaattggctcatgtataaacaaaatgtgatatatgcatgcaatggaatattattcagccattaaaagaaatagaatgctgataatgacatcatattgtatgattccatttataggaaatgtacagaataagcaaatccatagaaacagaaaagagataagtgcttgccagtggttgggtattggaggaatgggaatggctgctaattggtacggtgtttataatgtgatgaaatgttttggaaagagatactggagatgattgcccaacctcgtgaatatattaacatcgactgaattgtaccctttaaaatggtagacttcatggtatgtgaattatatcttaatttgaaaaaattattttaaggtacgagtaatgtagatttcaggaatccctttatgtcttaaaatgaatttattttgacactacactttgttgatagtttgactgagtaaataattctaggttcaagaggaattatttttttttaaaccttgaagacctttaccctaccatattctagctttcattatggctgatgagatgtctgattttttccccctttctttatttgcttatttttctttccctccttccttccttcttttctttttttaagaagaactagaaattcttcctggaaacttttagagtgtcctctttatctttgtttttctgaatctcacagttatgattctgacagtgagtgttaggtaggaagggaaataattcatctttatcaacatgaatattgcttctctgttcaacttataaaaatattcttcttttttaaaatttatttttattgaagactagtttatatacattgaaattcacacatcttaagtgtacaatttgatgagttttagcaaatgtacatacttgtgtaactaccatttcatgtgctttttggtcatttgtatttttttcttttctaaaatgtttgcctaagtctctttctcatttacagtggatccaatttgtcaattttttcttttacagattgtgcaagaggaagatgtatgtcacgtcaaagaattatttgctagtcctaagtcctgaaatttctattttttcctaaacattttatggttttatattttacatatgagttcataatgagttaatttttgcataaagtatgcgttttaagttgagcttcttttttttgcttacaaatgtcactttgacaaattttaaaactgagttatctttattactgagttgtaagaattctttccatcccctagatacacatcctttgtcagatgtatgtattacaaatattttcttttggtcctggcttgtttattcatttgcttaacggtgtctcttatggttttacattttgattaaacccaatgtgttagtttttttgaggttggtacttttcggtctcatggaaaaaaatctttgccaaccccacagtcatgaagatattcttctgtttttctctagaagccttttagttttagcttttgagtttaggtccatgatgcatctcaaaattagttttttgtgtagcatgaggtaaggattgagactaatctttttccatatgtccatctaatttttccagcaccatttattgaaaagatttttctttcctatataatttcctatagtagcattaagactaatatggctatgtacttgtttaggatgcccttgaactcctgtaggttgggatgatgaccactggtatgcctcattatcaaaagtgtcaaatccctgctgcctcatgtcattggctacttgcacataataattttgtctatcttcagggttctggttttccttctctttctcttcttcacaatttgggtaatagtcatctttgcagccatcagattcctagctgttcatattcagaggtatcttgatgtgatgggatactttgtttacccccttcgcaggcaggaactggagtggttctttcactctgcccaccgctggccactcctccgctcaggagggagggtgcgagcgagcaagtgcaggaactgaagcgaacaaacactggaactggccagagtccaagcatgttatgaccaatactctgtcagatcagccgtccagggacaggggagtgccaaccagctcactggagggtcaaggtggcagcctctgacctctcagcacccaggttcttgtccagcatccaggaagaatcaagtcacatgaactgtttgagaggttgatgaatgcagaagactttattgagcagtggttggctctcagcagaaaaggagactgaaaagcggtcgggaaaatgatctctctctccctgaagcccggctgcccctctctgaagcagccctgtctgaagttagccacatctatccatagtctccaacgttcagttgcttctctcctcgctgctcagccacttgtgttgctctgccagctgaagtcttctatgggcacaggataggagcatggcaggccaaaaaggtaacatttgggcagaaaaacggggtcagctgttttcacttggggccgcagtttcaggcatatgggtggggtttagctgggagcccagcccttctgtatcattgacagccaagtttcagataaaaaaagctgcttccttccctcaccctctaactctttaaaactttattacttcctcaaatgcattagaaatttgtgtctgtatttttcaaggtcatacacaaaggtattactaaaattaccatatgattttcattgagaactcaatcttttggcagctaagcattaatcaggttagccaagttgttccttccaaggagggttccgggagggtacaggtcacagccatagaacaggaaagaagcaggccaaagctgatatgtgatccaggctgctttctccttctcttgttccgtcatcattttcaggtaacttcatcttgacattctgcaaaacataattctggtcgactacatgagtggcatgatgctaatgtgacttatgagcaagaagtggcaaataccctacatgcccaagtaagtacatagtgagaaataattccatagagattcagaggcctaccatattgttgaaattttgaagaatacaacaatccaatacatgtgttataaggtaaagacgggtggtagaatattgcgccatctatgataaataaagaggcataggccaagcctggtggctcacacctgtaatcccagcactttgggaggccaaggctggaggagtaggagtttaagacttaaactcacttgagcgtaggagtttaagactagcctggacaacatggcaaaactctgtctccacaaacaatacaaaaatttgccaggcatggtagtgtgcacctgtagtcccagctacttgggaggctgaggtggaaggattgcttaagcctgggaagtgtagtttgcagtgagcagtgagctgtgattgcacttgcactccagcctgggtgacaaagcaagaccctgtcttaaaaaaaaaaagaaggaaagggaagaagaggaggggaggggaggggagggaagaggagaggggagggaaagaaagaaaaagaaagaggcataatggtttctgggtttctttggattttggagaaagcaaatactatatactttgagtggggaccagaactacaagcaggtcaagacaatcatgcaagctgttcaaacacttgtgtcatgacatcagcagatctgctactgctggagataatcctgaccctgaaactgctgactaagctaggttaggaggtacagagttccacccaattagaagttatgactaataagtgtaataagtggagtcactttgggttactcattctattgagcaaacaggtgaaaaatggagttaatgcactggctagggtaatgaactctgagctagagttactactacctaattaaagcagggaggatatgtctggaaccgaagggagtcagtggagcatctcttaccatttccatgcccagtgttaattgtcgtcgggaaattacagactcagatgaagttccatgccacagcaaatgggatcgggcttttccagtaactgcccaaatgttcttcccctctttctcagcctcacttcccttttcttacactcttactattctgagatggaacctcgccccccaaaatattaacaattaagctttgtttgagtctctattttccagaggactcaggcaaaggccccttccaacttctagtctttagtcattcaatcattctagggctgtccagtaaaaattagacagcctgaggctgagctgttcaatagaaacaatatgagtgtcatataaaatttttaaatttctagtagtcacattttaaaaagtaaacaggtgaaattaattttacttaaaccaatatacctaatatgttgtcatttcaacacatatttaatataataatgaaatagtttttttatattaaggtttcaaagtctattgtgaattttatacttacagtatatctcaatttgaatgttaacttatcattggaaatacttgatttatattagatttcataaattttacaataaaaaagattcacattcccaagttgttccaaaatattgggagacaattctccatgggtctctcatatttccgaacatcttgtgagcagaggcactggttgtctttgttctgaactatctttaaaggatgtctgtatatcaaatagccttggaagactgacatagtgtctccctctgaagcatgaggtaggtatgcttattgtccagatcataaagttaatgtgcagctgtgcttgcaggacagttctccaggtagcgttatgccacccagttcctcctcctttctggcttgtagtcctcaaaaagtgactgtagaatgtactgggaatgcaacactctaagatgaggagggactgtgtaggctctattatagtctctcttccctagccctcagaacaggatgtccttcaaagctctggccctgtgtgttatgaccccaaagtatataacccaaggtgggctgcctttcagggtccctcagctgtggtgcaagtagggcacacattgttgagactctatttgccctaggtaaatagagctttcaaggactggctcacaatggatcctgggcttcttttgtctcttgctgcctatctgcaattaataaatcatttcatgtaactagtggcatatgagtgtgttatttcttaactcaggtaagttggtaaccagtgtacagtgaagctgctttgcattgtttaccaccattgtaaaatatttaggttccctgaactaaggattccttacctataagacaatcagctgtgtatacagatgtcatttgaccctctttgtattgctctgtaggaatcaggcagaaattggttcaaagaaatactgattctctgactattgctattgctgtgattaatatactcctttgtcttgaacccaggggttctgtgcctttttaccagtatctataaaactgtggaaggttgatttatcttataagcagggtaccatctcagaccacttacagttcttgacacaaaaatacttgaaagttttccagtaacctaaattgagtaccagaaaaaaaaaatcactttcctttaacagtcacatccatattaaaaaaaaaactgcctcatattttttagaaaataattgatttgactttgaaagcaaaagcatatcaatttcaaaactatgtgttcaagtaaagtacattcactaaatcttacgttgactcagtggtattgatattgaattcaaaaagagtatttcataaattgaaaagcaacttgaaatttctctcaatatcaatagtgttcaaatttttcttgtagttcttactgttaatttatataatacttttgatttaattaaaatctcctgcatactgatttgttagaaaatgtaaactcttttaaaaatgcgtaaaatcattattattggtttgtattaccaaaagtttaaatttcaatataaatccttgtacttgtctaaataggtcacgagcttttgattttcttggagtttcaaatttagcttgttcacatgcactgtgatattgataagaaagcataaatcacacggctgtatttttctctttgattatggaatatttgtacaactttgtaatgtttatagaactcttccataactcaaccaatgaatattgagaaagaacacaagatagctaaattcattctcttctatttctttcaattgtttcataaactggcaatgactcacagaatttgcatggatacacggaataatttcaataactatatccattacctcttcatagagtttgcttcagaaaattgagcccagatatttttaatatctatcatacagtggaatgaagcaataagaaatcatgagtcacttatttcaaaatgccaataaatttagattttgacctaacttagctagagctttgtctctgatgatataaattaactttttttcctttaaattattttccaacaactgtaaaaataaaaaaaaaaaaagaattggctgggtgcggtgactcatgcctgtaatcccagcactttgggaggcagaggcaggcagatcacttgaggtcagcagttcgagaccagcctggccaacatggtgaaactccacctctactaaaaatacaaaacttagctgggcatggtggtgcgtgcctgtagtcccagctactagggaggctgaggcgggagaattgcttgaacctgggaggcagaggctgtagtaagccaagatcccgccactgcacttcagcctaggtgacagagtgagactccgtctcaaaaacaaacaaacaaataaacaaacaaaccgcatcatgagtttgattcttaggccatgaattgatatttctctgtaaatttggaagttctttgagacacaacatacccaaatatgggcagtatttcttatattacctgatttgtctatagctaaagaaacctatttgcaacattttaaattttgaatcaattgatttttgatagttaaaaagatactgcattctacagacacttgtttgataatttaattgaaaatcttttactttttaaaaatagtttttagccatttcttcataattttctaacatttccataaatgatataatagtttattttacaatctctccatctaaaaaaattgttagagggtgtgtgtgtgtgtgtgtgtgtgtgtgtgtgtgtgtaagaatccaagaccttttataactggccatatttacaaacttggatcctgtcagatatcatttaaatttttttgttgtacttttaattctgaattcaggcaattaatttgatcaattctttttgactgctgagaggaaagttcttatgatatttactatgtttttgctaaaaatgtctctcatgactgtgtattttataatcttaatattgttatacaacagataaaaagtcttttcattttgctctgccctaataaattgcaattgccattcattgtgaattttgtaacataccctcttccagaccgtttattcattccagtcatagtagtacctttgacatctccactgaatccaatttaaatgtaaaaatttgttcttcctcttctttttttttttttttatgagacggagtttcactcttgtcgcccaggctggagtggagtggcgatgtcagctcactgtaacctccacctcctgggttcaagtgattctctggcctcagcctcctgagtagctgggattacagacacctaacaccacacccggctcattttttgtatttttagtagagatggggttttgccatgttgggcaggctagtcttgaactcctgatctcaggtgatccgcctgccacggcctcccaaagtgctggaattacagacgtgagccaccacacccagcctccaccacctcctcctcctccacctcctccccccaccccaacctcctcctcctccttcttcttcttcgtattattattattttttggagacagagtctcagtctgttgtccaggctggagtgcagtggcatgctcttggctcactgcaacctctgcctcccaggttcaagcaattctcctgcctcagcctccctagtagctgggactacaggcacgtgccaccacgcctggctattttttttatttttagtagatgttggccaggctgctctcgaactcctgaccttaggtggtttgcccgccttggcctcccaaggtgttgggattataggagtgagccaccatgcctggcctattttttaagctagagaaaataatttgatgatataattaaaataagtatttaaattttattaccaattaaaatttatatctttgtaactttcactgtctgcaaaaatatttaaataaatcagtgcataggaacaaaacatccaaattgaaaaacctgtaactgacaatattgatgatatatttatatgtaatactagagttgacctacatgctcaacatacactgtataacaatgtcttatatgatgcaatggttaaagtgaaatgttgccctaaccaaactgtaaagttgggtttcatggaaaacatgctacttttcttcagtttttaattttaaaatgtgacactagccacatttcaagtgctcagtagccatataaggctagtgaccctcatactggaaagcacagctgtaggcaacagagattcagcagtaaacaaagcaagagaaaaatccctctccccttgggcctcaagttttctgtctacttatattttatttacttaaaaaacaacatagagctgtattttgaatttttattgagtctgaaaatctttgtactttgattggataatttaatccagttacatttatttattatgtttatttattggcagggtctcaccctgtcgcctaggctggagtgcagtagtgcagtagtgcaatcatgactcactgcagcctcaacctccccaggctcaggtgatgctcccacttcagcccaagtagctgggaccacaggtgcatgctaccatgcctggctaatatttctgtatttttttgtagagatggggtttctctatgttgcccaggcttgtctcaaactcccaggcttaagcaatcctccagcctcggacttccaaagtgctgggattacaggtgtgaacaaccgcacctggccccaattactttttgaataattacttatacaatttggaattttacctaccatattgtgccttctacttgtcctgccatctctagatctctctcatttgcctttttttctcctttgtctattgatttcttctcttctaatttagaaattatgcaccttttctattttttgtgtttaccctacattttaaaaggctttttattttgagataatttcggacttatagaagaatccacaaaattagtacagaaatttcccctatacacactgaccagattcccctaatatcaacatattacatattcatagaataatcaaatgtaattaaccaacactgaaataatattattaaataatctaccactcatagggtggaatgcatccagagcatttaggctgcacaggaagttgcagagggactggtagatctgtgtagagcactgggccacaggtgagctatgcacaggttgtgcagaggctggtaaagagtgacttcagatgtgtgagtctccaggccacaaacgtcagtgcaggccatgcaagagctttggtttccttgtgaagaggggtgcaaaaaggttatcagcaggccaaagctgcaaggtcacagacagattgtgttttgggcctgtggatatttactggttgtcttcatactcacactagccaaccctcagcccataacaggaatagcaggagaacctcttcctctgtagtattcctccaatgccctttacttagaaagattaacatcgtgcccacgttaaaggagggactctgaaaaaaattcagttgcctatcacagaagatatacagtaacagatgttccttgacttatgatggggttacatttcaatgaactcattgtaaatacaaaatatcataagtcaaaaatgcatttaatacacttaagctaccaaacatcatagcttagcctagcctactttaaatgtgctctgaacacttaacattagacttgttttggattattttatcttactgtaggctattttatagtaaagtgttgactgcctcatgtaatttatcgaatactacattgaaaatggaaaacagggccgggtgctgtggctcatacctgtaatcctagcacttttggagactgaggcaggagacttgtttgagcccaggagttcaagaccagcctaggcaacattgggagacactgtctctacaaaaaatataaaaacaaaaattagttgggtgcagtgcatgtgcttgtggtcccggctactcgggagggtgaggtgggaagactgcttgagcccaggaggtgaagtctgcagtgagccatgatcgcaccactgcactccggcctgggtgacagagtgtttcaaacaagaaaaaaaaaagaaaaggaaaaaacagaaaaattgtatggctactcaaaagtatggcttttactgaatgcgtatcattttgcatcatcatgaagtcaaaaaattgtaagtcgaaccattgtaagtcaaacaccatctgtagtatccctttatctatggtttcattttctacagtttttcttacccatgattcaccatggtgtgaaaatattacgtctctactcttgtgctttgggaacattattaagtaaaaaaagttatttgaacacagcactgtaatactgtgatagtccatgtgattaccaagatggctactaagtgactaacagaaatctgagcaggaaggagtgggatggcatgagatttcatcatgttactgagaacacagtgcaatttaaaacatgaattgtttatttctggaattattcatttatgtcatcatgcttatgtcattcacttcatttaggcattttatctcatataatcacaagaagggttagtacagtacaataagatgtattgagagttcacattcatcttattacagtatattgttataattgctgtattttattattaatctctgtggctaacttataaactttatcatatatatatataggaaaaaacatagtgtatagtgggtttagttctatctgtggtttcaattatctactaggggtcttgcaatgtatctcccaaggataatgaggaactactttattgaaaggcgcatttggagcctggaagcagtaaattgaattcgaattcaagctccaattagccatgtgttagaccaagttatttttccatggttcttaagctgttactttcatcttcatcttcgtgctacattcagaatgattttttcatatctttcattcctctaattctttacttagctgtgtcaactaggctattaaacctatccttaagttttaattagtttgttttctaaattctggaagtactgcttttggttatttttcaaatctgattgatcattttaatagcctcttgctctttattcatattttaaacttattttatttctcccataatgatagagaggtaagattctggaatctgattatctagatttaaatcccaacctctaccattagatgagtaactttgggcaaatagtaacctcttttcctcagttgcttcatctataaaatagaaataatataagcatttaaataagtacacaagtttgttatcagaattaagagttaatattatgtaaagaattggccgggtgcagtggctcctgcctgtaatcccagcactttgggaggccgaggggggcgggtcacctgaggtcaggagtttgagaccagcctggctaacatggtgaaaccccatttctactaaaaatacaaaaaattagccaggcgtggtggcaagcacctgtaatcccagctacttgggaggctgaggcaggagaatcgcttgaacctgggaggcagaggttgcagtgagccgagatcataccattgcactccagcctgggcaacagcagcgaaactccgtctcaaaaaataaataaaatatctgtgtgtgtgtgtgtgtgtgtgcgcgcgcgcgtgcgtgtctgaagaatttagaaaagtgcttgacacttaaaagtattacataaatgttggttattactatcttttgccactgatattttaaggtgaaattcacatattaactattgtaaaatgcacaattcagtgtaatttcatgtgttcacaatgttgtatagccataataacttctagttccaagacattttcaccacccacaagagactacatacccatcaagcagtcattccccatttccctatcttcctagtagctgaatctgctttctgtctctatagaactattctggatattcatataaatgaaattatacaatatgtgaccttttatgttttgctcctttcttttagcaaaatgtttttaaggcccatccacattatagcatgcatcaatactacaatctttcatgtggctgaataatataccatcgtacggaaataccacaatttgtttcattgtttccatcttttggctattgtgaatagtgagtgctgctatgaacattcatttacaagtatttgtttgaatacctgttttcagttgttttgggtacgtaaccaggaatgaaattgctgagtcatacaataattctatgttcaactttttggggaactgccaaactgctttccacagaagctgcaccatcttacattcccaccagcattgtaccaggtttccagtttcacaaaatcctcaccagcacattttctattttaaaattttacagctattctatggggtaaaaagtgatacatcattgtggtttggacttgcatttctctaataactagtatgttgaacatcttttcatttacttactagccatctgtttatcttatttgggaaaatgtttaaatcttttgcctgtttttaaatagggtcatcttcttgttgagttttaaaaattctttattctgaatactagagcctaatcatagatgacttgaaaatttgtgtccattctgtaggttatcctttcatttttataatgtcttttgacacacgtttataatcttaatgaagtccaatttatctttttcctttggttgtttgtgcttttggtgtcatctctaagtattgccaaatctaagaacacaaagatacactctcattttcttctaagagttttatggttttagtagctcttacatttgtgactttgatccattttaatttttgcataagatgtgaggtaggggtccaaattcattcttttgcatgtagatatctggttgtctctacaccatattgttaaagagactattgtttcccattgaatggtcttgtcatctttgtcaaacatcaactgaccgtaaatgtatgataatttctggcctctcaattctattccatgagtctatgtgttcctgtgtatgctattttgattactgtagctttgtattaacttttgaaatagggaagtatgagttccttactttcattctttttaaagattgtttagctccttgcagtcctttgcaattccgtatgaatttttacactttatcatttctgcaaaacagtcattgggattttgataggggttgcattgaatgtgtagattgctttgagaatcactgtcatttcagcatattaaatcttcaaatccatgaacacaggatgtcttttcatttattcaggacttctctttcagaagtttgatagttttcagtgtacatgtttttgcatttcccttattaattttttctttttttgaaatagagtctcactctgtcacccaggctggagtgcagtggcatgatgtcggctgactgcaacctctgcctcccaggtttaagcaattctcctggctcagcctcccgagtagctgggactacaggtgcacgtcaccacacccagctattttattttttttgtatttttagtggagatggggtttcaccaagttggccaggctggtctcaaactgctgacctcgtgatctgcacgcctcgacctccgaaagtgctgggattataggtgtgagccactgcactgggcccctattctttttgatgctattgtatatggaactttcttaacatcatttatggattgcttagaataattatttaaagaaatacaactgatttctgtgtgccaatcttgtatcctgcaaatttgcctaattctatgagcgctaagtggtttttatgatttaggattttccatatacaagatgtcacttatttagtcttcctttacaatttgactaatattttttaaatattgatatttaatgttttgattcttgcaaattggttggcaactcatggtgctacattaccttgtactttttcttgctggttttaaaatgtgagctattatgcaattcctacagtgtttgcttctgccagtagctggttgttttactaatttggaatcactctaaaaattaaatcctctgcttgaatttcctgggaccacctaagcctgcaaatcttcacaaagcccaaactgttattacaaattctcacaatattctcctgtcacagagcaccaagtttcaagataggtagagtcctagttgtactaggaatgggtttctcgtatttgacaccacttttgggtgcatcctgggctttgccagagtcatgaaaattaaaggtcagctgggcatgatggttcacgcctgtaaccccagcactttgggaggccgtggcgaatggtcttgagcccaggagttcaagaacagtctgggcaacatggcgagtagccccaactactcaggaggctgaggtgggaggattgcttgagtccaggaggtcgaggggtgtatcactgcactccagcctgggtgatacagcaagaccctgtcttgtagaaaaaatgaaaaaagttcacttggggtaggtacttcaagtgttttcaaaatgcaatgcaagctggttctgggtatgttctgttttcttctgggttcttggtttcagtttggttttggtgagagtactccttcctttcttgatagaacattgacacatcgaaaaaaaaaaaaaaagttttcccccagcaagtggttgctttttcaaaggatttatcagggtaatcatccaggctgacagaatctgaactgcattattttacttacaataaagaaggtctgattaacaaatttttaatagtatattagttttctttgttcttttggagttagaaatgaagcaagcaaaagattaaacattttccctaagaagatatacaaatgacgagtaagtacatgtacctttgacaggctaccatttggctcagtcatttgtgttaaatatttgatcacctaaaatgttgcaagtagtcatctcgtcattgataaataagagaaaaaaaatctgtcctcatagaactggggtggcgctgagggtgagacaattattacctataagatagataatactgaatatgccatgatgtactctatagaggtgatgctgtgttggtgtatttatagaatagtcaagaaaaaccactctgataaggtatttgaatagagacctagttagggaaaaggaagctgtatggtatgtggggtaagatcatcctaggcaaaggtaagaacaagagtaaacatcttcacacatctttgcaagtctcagcagtcccatgtgactgagctgagagagttggaatggtggtgagacaagcaaggaattggggattaagctgaggcaaaggtagggaagaaagttatctacagccttgtagattacttttaataccttgtgtttttactccgaatgagatgggaaaccattaggtttggaggaaagccatgccatctgataaggtttaaaggggttgtgtgtgggacagacagattgctgcaacgtggggagatcactcaggaggctactccaataatccaaataagaaatgatatagctttagatcatagtgctaacagtcaacatgataaatgggcagattctaaaggctgctgttaagtctgattgaaggtggagtgtgaaaagtcaaagatggtgcctaggttttaggccattgcaatttaatgttgacatttactgagcatggggtaatagtatatgtatatgtgtatgtctttatagacatatggccagttttagacattttaaaagacgccctttagcttgtcatgtggataatgaatagaagctatatgggagctcaggagaaatagcttgaaggttagtaaatgacggtggttaactgggctcctaagatagtatgacatgaaagttcattgtttagccttgactacaaatttgatacggtaaatgagaaatcaagttctatagaggatcagacagtagtacgtaaaaatgtaaatttcataatattttttacaatacagaaaagagggctcttaaaaaatctcattcataaatagcatacagtttgggaagagctagatactgataatgggactttaatggaagcatcccaagtaaaagaacaattgtcagaaacatcttgtatacctgaatcatataaaatttttcaaacctgaggccagaaatgagcaagtagttataaggtagcaacaaataatgcaacacagtaataatttctagggacttaagacattcggccaacttcaatatatttaagtctttttgttaaaatggttcctcaagtttttttggcagggggtggcactgtcatgttttgaagccatttccaaatacctttaaccgtttatttttccattacaatgggacagcacgagaaatcttaatagtcaccttagggtacctttaatatctgtcaaacactgcaaacacccttaacatagcatcatttccacttggaaaaattgcctagtgtcaggccacagaatgggatctgggttcaaatttgttcagctagccaacacaatacttaggtagatctttgcacctgattacttttaaatacttgacgattggttgaattccatgccagtatggttattcaaattagccaactgtaggacgttaatgtattttaatattccaagtgtaaatgtggaaatcaatgtactgtattactattcaaagtactaggaaattgtcaggtatcagaaacgtaatacttaaacacattctctaaagccaaaaacagctataaaaaaatagctgtagagtcaaaggattactggttgtagtctgttacaagggaatgctacgaacagacttctgaaaacggttctcaatcttcactattcatcagaatcacttggagggtgttttaatataggtgactgggctccatgccagtttgactcaggactgggatggggcctgacaacttatattataaagaatttcctaaatgatgctgagattgttatctcaagaaacattttgagaaccaccttattcataaactgtataaaattaaaaatcgagctcacacacattaagctcaagtgtggatttcatgttagctggaattaccgagtaagaccaaagtgtctttaaacacagactttaatggtaacaattcctttaagctcaattaacttcagctattacaagtcttatgcagatgtcactattagacaatatttagtgacttgcactgggttcctcataaaagacaaattcacttaaaagtgtaatcaacaatcattaacagttttgttatgccaacacaaaacatggctgagttacccccctccccgcccaaattactaacacagcatgatcagtaccttaagtatacttcaactaagccatttcaacaaacaaacaaaaaaaaacaaacaaaaaaaaaagtgagtgtttcactacccctgagaccactagttaactgtggttcatactttaaaatgtgagtacacccacacaagaaagcaaattaatcagttttaaaaaatctgattatcacattgcaaactcgcccaggaaaaacaaactgagtcatttaaaatgtaaatttaccattaacaggccaactggaccctaattcggtttatgcattaaaagatttaggaaatacaaagacatagtcaaaactgattctaatactcagttgggtcctatacatggcactagtaatgtcaaattactgggtggagtggggcaaagagggcaaattcttagattcttttaagatttcattgtacatatctcatgtccagtgtccatacattcaaaaatgttggttttccaggtactttactgttcttttaaacctggagaagcctctatggcttattcccttagaagcaacaaatgaaatgatgtataaagcatcaagtcaaagatacagagaactggacacatccactaattgttatgacaatcaaagaagtcatctccgtaaatacctaagggttgtctaaggctataaaggtcaatttgaaagccagttagggatccaccgtgtttcataaaagtgtcttacactcatgtttggctttcaagaagtgatatgcctactaaagctgttattttgagactatatgcatctcagaagtaattttgaaaatagagccaaagagcagtttttcttaccttgtggagcagaatgttaactaatttctcattcataatttgaatccaaaaaagttatgcagtatgacatctaccctgaaggagccgttttaagcaaaacacaaaatgaaaaaattcactcattggaaaaactgcgtagctggttttttccccaatgaaatgattacagaattaacaaagccagaacatcttcagaaggcatgcatttcacttccagtttagagaagaaccttaagtcaataaatcatgtccaaactacatattaaaatgtttataaaaagtaagttttaacatttatttctagctttccacatgtgtgtgcagacaaggaataagattgcacgtaagtgtaagcagtgcaaaaatgtggaagtggaggagtcacagatgtgctagaactttaagaaataaagcagtgaacaaaatcaaaataaacaggaaaaatgtaaaactatgggatcagaattaggaaaggtgaagaatggtaatgcccttgttactacagaagttaaatcagtggcacagatagcacttgtcaaacaaaaaacaatccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgccggtggttggtagaggaaatggaattccccagactggtaagagcgcgcgcagacacagccttgtctcacgcgcccaatcaggagcgtgtggtgggaggtgccaaggattaattaccagatacctttagtctagctcgagccgggattttgaggtttccggtggagcaggtgagcagtatttactcgcctgccctcctgggctggttatggtgtgggaggaggcgcccctcgagatgggaatagtagttttaaatagacccaggttggccgctcatcagcgctcccacgtgctgaagtctagtgcacgtctgaccctaagggagcaatactgagaacagcagggagcaggctgagtcaagctcaattgagtggatggggctaggacagagagagttaggggcagggttttcactggtctccgtaatcagtcgctgccgtccgccaaggtgtagatgtgggaacaagcttaaattctcaaactttagcttctgttgctgtgtttcagttcttgagccagaaagtgttgagactaattagttaattaggtagagtttagagtcagaaaaacaatacaatacttcctgaaatatccaagttgggaggtgggatttacctcagtaggattggcctgttttagtcaagggtttaaagtatggagacggcagttatgctctctagtgtatccttcaggcaaaagaaagaccttaatttttatgaggaatttaaaagtgggtaagcactgaccagcttaaggttttttaacattccttaatgaccccagttaccgaagtggagatcttcaattacttggaaaaataaacttgttttaaaaatacacttaatttgaaaactgttgcagaaagttttacctaataaaaacttaacacgtcaacaatgatgaatataagtagtctaatgtatactgttcaagtgaccatgtagtgtcactagtgaagcagtgtttctcaaactagtgtccataggaaccacctggggttttgttgaaaatacgactttgatttggtagggcagtggtggagcctgagagcctacatttctaactagctcccaggtgatacagatttttctcgtctgaaccaccccgtgagtagcaaagcactgaagtgcttacctcatggcctaactgctcatgaggctcacctcagtaacacctctggcccctccctcctccctgaataatctgtgttctctctcatagctagccagatatactaaaagcacaggactaggcatgaagatggagggaggaacccagattagttattgcttcccatttgcttgatattggcctggttagttatcttctaaccccgtttcttcaccgctaaagtaagtaataatgactgtcctttctcacagggtgattgtgtggttaaagtgtcataatatatgtgaaaggacactggagactctacagtgctgtataaatgtcagttattaaagtaaccagtcagacattaactggccatagtgtgaaacaaatgtatagtagtaatagtggccacgcctgtaatcccagcactttgggaggctgagacgggtggatcatatgagatcaggagttcgagaccagcctggccaaaacagtgaaaccccatctctactaaaaatacaaaaaattagctgggcgtagtggcgggcgcctgtaatcccagctgcttgggaggctgaggccggagaatcgcttgagcctggaaggcggaggttgcggtgggccaagatcactgcgacagagtgagaccctgtctcaaaaaaaaacaagaacaaaaaacaaaactaatatatatggagttctagattatccaagcttataaaggcaagtgattgtgtaatcacaaactcattattgttaggcagtgaagtaaattcattggttgattgggctttctgtttacaagtttgtatttgcataagtggacttacgtttctgcttatattttgccatggttaaaatcaaaagaaacatagcctagaagcattttgatgccttaggataaagcaggctaagattaagttaaattttaaaacattattcatgtacctgttgttacagagagcccactttacagttgcaaataaagttaaaacattttcattcatttaacttacttgaattacaatggtagagatgtcctcatttgaaacaagaaaggaaaataatcatgttttttatattgcagtcggaaataatgctaacaagaaaaaaattatggctgtaaatactgaaagaaaaatttacatttagaaattaataaaggtacaaaaatgttgaaaatttaattaactaaaaataatcccttccttaataaatactattttgaagtcctaaaaactttgtaaatatagtagatcagattatcttgcatgaattgacataaaacatgagaaaatagaaaggatcaagaaaattaaagctgggctggtggcttacgcctgtaatcccagcactttgtgaggccaaggtggaacgatcacttgagcccaggagtttgagaccagcctggataacatagggtgacccagtctctacaaaaataataaaacaattagctgagcatggtggtacacgcctatggtcccagctacttgggaggctgaggtgggaggattgcctcagcctgggaggttgaggctgcagtgagctgtgattgtgccactatactcaagcctgtgatggagcaagaccctgtctcagagaaaattactagtaaatgggcaattaatctaccaatctgaataatggtggtgtgccagggtcttattacatgaatttttcagtgaggccacgttattataataacttgagagtaaggggttaattagaatgtattgatgaataaacataattaacagattttatatatatgtacttaatattgtatctatgttttcatgtatctttaattttgttacagaatattataacttgccaaagacactggctctagtacagtgtataccattttattagttttattaaattgtaaatgctacggtccagattttatattcagaatgctcatttacatattctgcctggaccaagtaatttggagcccaggtcaaccaaatgttattttacattgtttgcacaaaaatcaaattgatttctatacttaacaattcagaatctcattaagtcaaattaatatggtttaagaaagtgtactttatttcatgctaagatgtcattttggccttaataaggcttttggcatgtaatgaagcatgcacaaatctttgagataaaaatagagcatttttccacacaaaaacatatatatacacaaatgttcagagtagggctattctactttttagtagaaacaactcaaatgtccatcagctgatgaatggataaagaagatgtgatatatgtgtataatggaatattattattattataaggaacaaagtactaatacatgttacaaaatgtatcttgaagccttaaaacattctgtcaagtgaaagagccagacacaaaaggccacatactgtttgattctgtttatgtgaaatgaccacaatagtgcattctgtcttccaaaaagctggtttacttacaaacacaggttaaaaaaatatatatttgtaatactgcttttggtgtagggtgaggcacgataaagagactttcattcggtttgtcaatcagtgatacttaggtctgaataggcaagtgggagtctttcaggtttaggacaaagaatgttaatgtagtagagatctgttgatagagtcactcctagttttctatttatttaaaaaacatcgaattactattaggtgctagacactgaagatacataaaagacacagatgtcatctataagaaagtctcttgaggagaccagtaagcatcagacaacatcatagagtgggttcagtgacataaatgtgtgcacagagcactattaatgtactgaactcagctggcggtggtcagggaaagtttctctgaggaagagagttgtattaaaacaaatgaaaaaaagggagcaaggcaaagttggaaaaaaattgtgagggaggctcctaggcagaggaaacagcatgcaaagtctcagagatgacttgataagtttttaaaactagaaaaactttggctgcagtattgcgaggttgaggtggcggggggagcggcaaggagagaatgagaagacagaaaagatgaggagacaagatagatttgaaagacatgactggagatcttgagggccttttattttgaaggggatgggatagaatggagaaattgaatttttaacaaaaatggcctgatcagatttgatggcaaaaaggtaactgtgatagcaatgttgaagcatgtgcccaaagtatgtattgggatggagactagaggcaagaaaaacaggatgttaatgaaataatcctgaagaaatgggagaaagatctgaaatagttgcactaataagagagagtacaggaagtaaacttagtttatttactgggtcaagcttgcctaaaaaatatttgggggcggggggaattctccctccagttacctttattagaatgttacaataaaatcaagccaggcacagtggcttatgcctgtaattccagcactttgggaggccaaagcaggaggattgcttgagtccaagagtttgagatcagcctgtgcaacatgatgaaactgtgtctctacaaaaaaattaggcatagtggcatgtgcctgtggtcccagctgctctggaagctgaggtgggaggatcccttgagcccagaaggtcaaggttgcagtgagccatgttgcagcagtgcactctagcctaggtgacagagtgagaccctgtctctcaaaaaaaaaaaaaaaaagtttatagaaaaacaaaatatgatattctaataaaataacttgaaacaatagtatgaacttcctatgtttttagctcttaaagaactacgaaactaaagtttacataacattggaaacatgtgctacatgtttttttttttttgcaaatcaaatctcctcttgaaactcaaatgtaggactaactgccacaatttcatttcttttaaatttggccatgtctgtactaactgctgtgatccatgtctcagttctcttaccactttactagaacctttgggagacttttgttcattctttgactgatatcatttggctttcaagtggccagaaaaaagaattcattatctatttctgttccatctgcctcagacaaaatactattatgtgttgccaacaagatcataaacctaaataaaacacaggttctaaaatcacatggcagtacttagtataagtgggtatcaaggtgactgggactgtgcttacagtaattatagattactaaaatcacaaaatggaaaaaagttcatgtagagaattcaaagaatttagtttgatgtagatagagattataacaatccttttgtcacatacctaaagtggaatttgttgagtttgaccttgtgacttttgagtcaagaaatgctaggcaggtagaacagataaattaataaacctgattctgaaatggaagtaaaagggctttaaagatgttagaagcattttaagattcattctcattctggatctcaggacataatttcttatagaaaagtagttgtgcctgcagatcaatccacaaaaggctttaaaacccaccctccctgtatatattacacctatgagaaaatgctccatagaattccaaattgataacaggaggaccgacctacccctctgcccgccagaattcccgtggctcagggcaagtactgaagccgaataggaagaattgactgagggtaaatcatgttgagtggttggttgaaagctttgaaaagttggagaatggtggttaagaaatctgtacattcagacttcttgaatgtcactgtatgttttgggttagtgctgggatacttttcttttttagtgccagatccattaatttacattcctctccactgccattatcaattgcttcctaacagaaaccagtaagctttctttttcccccttttctacagagaagagcagtttcacaagattcaacttttcttatacttttgttcctaaaacagatacacactctgttaagttttcataagggtttttatttctgcaagtatgactttagtgtttatatatgattataagcaggcagctagcagggaaaccatgggtaaaggattaaaaaactctcatttgatcctggtttccctcctaccaccacttcagcccccaatccctgcctaacaaattagacccaatagaaaaagtcacaagattgagggccgggtgtggtggtacatagctgtaatcccagcactttgggaggtcaaggcagggtggattgcttaaacccaggagttagagaccatcttgggcaacatggcaaaaccctgtctgtacagaaaataaaaaatcagcatggcgtggtggtatgcaccagtagtcccacatactagggaggctgaggtgggaggattacttgggcccaggaggtcaaggctgcagtgagctgtgatcaggccactgccctccagcctggatgacagagtgagaccctgtctggaaaaaaaaaaaagattcaactttttttttttttgtcttttgtttgttttgagacagggtctctctgttacccaagttggagtgcagtggcaccatcttggctcactgaagcctctgcctccagggctcaaggagtcctcccacctcagcctcctgagtagctgggactataggcatatgccactaggcccagctaatttttgaacttgcccacacagattctttccccttttccatccatctccaatccccactctctcaggataccctgatggctctgtgggtatccttagtgttcacttatcacagtctacagaaccaccagtctaatgaatataaaatattttaaattataatgaagaagcctcattatgagtaatagtaacatgtgaagcaaatacaatcagccctccagatctgtgagttccacatccatggattcaaccaaccacggatccaaaatacacatttttaattgcatattttctgaacatacatacttttttcttgttactgttccctagacaatacagtatatttacagtgtttacattgtactaagtattataagcaatctaaggaggatgtgtataagttatatgcaaatattatggcattttatatcatggatttaagcatccttggattttggtatctgagagtggttctggaaacaatccctcatggatactggaggatgactataatatgaagtatattagagataaacatataaagacaggcactcagaggagtggcttaccagcagacatgtaataaaaacatgagaatttcagttgcctgacatctctgtaagccagagatatgtgctttttggctgcccaaagaaactatttcagtttaaccctgaaagaaaggaactatgttgtctagcataaagcagttacctcttcctcatctctaccagttagaccacagctacattgttatgtttttaacagctttattgaaatataattgacatacaataaattatacatacctaaataaacagtttgataagctaacatatatatatatacccatgaagctcaccaaaatcaagataatgaacttcaccacaagtttccttatgctcttttataaatcctttctcttgttcttcccccacccctctgtcttcttaacccacaggacacctctgatctattttctgtcacggtaaattagtttgcattttctagagctgtattgaagttgaatcacaatacaacttcttgtctgccttttttcacttagcataattattttgagacttacctatattgttgtctctcagtagttcattatcttttattgctaaataatattccattgtatgtatttgccacaatttatccattcaccagtcagtggacatttggtttgtttccatttttttttttttttttttttttgagactgagtctcactctgtcacccaggctggagtgcagtggcgcaatcttggcttactgtaacctctgcctcctgggttcaaatgattctcctgtctcagcctcctgagtagctgggactataggcactcgccaccacgccggctaatttttttattttttagtagagacggggtttcaccatgttggccaggctggtctcgaactcctgacctcaggtgatccactcagctcagcctcccaaagtgctgggattataagagtgaggcactccgcctagcctcttccaatttttgtcttattacaaatagggctactacgaacattctttacagtgtttatatggacatatgttttcatttctcttgagtaagtagcttaggagtggaatagctagattatatggtagatatgtgtttaactttttaagaaactgccaaactttcccaagtgttttttaccactttatggtcccacaagctatgtatgagtgttccaatttctcctgactggttaggattagtcttttcaattttagccattgtaataggtgtgtagtggtatttcattgtcattttaatttgcattttcctagtgaccaatgatattggcattttttcatgtgcttctttgtcatccacatatcttctttgctgaaatgcctgtctgtatttttccccattgttcattgtattccttttgtcagtatttatttataggtgacacatatgggagtggccttaaatgttttttaactaataaagtcataacaaggtaacatatacctggaggaatatgaaaaagcatgacaaactttactttgcgagatagcaaaatttaagatttcactatataaatctgagtactaggtcaattttttttgtgggtttttgggtgaaacctgctagacagattctaaaagagcagtcacactatgtctattttttaaattattagctagcagaaccacctcaactcacattgactagtccctaagtcacttccacaattaagagtataggcagtagtgtgatagaactggcttgtaacagcttacaagggtcaatttaaaaattgtaggaattttgcaggctgattgttaaacacagccattattaaaaattatagaaactgacaattatattaaaatctgttaaataaagctcaataataaatactcaaaactcacttcctagttattttactatagacatacctaattttattgaacttcatggatatggtatattttacaagttgtaagtttgtggcagcccatattgtgcaagtttgtggtgccatttttccaacagcatgtgcctactttgttagtatgttttagcaataaagtattttttaattaaagtatgtacacaggccaggtgcaatggctcatgcctgtaatcccagcattttgggaggctgaggtgggaggatcgcttgggcccaggagtttgagacaagcttaggcaacacagtgatcctgtctctacaaaaaatttttcggctgggcgcagtggctcacgcctgtaatcccagcactttgggaggccaaggcgggcggatcacgaggtcaggagatcgagaccatcctggctaacatggtgaaaacccatctctactaaaaatacaaaaaaattagccaggcgtggtggcaggcacctgtagtcccagctactccggagaggctgaggcagaagaatggtgtgaacccgggaggcggagcttgcagtgagccgagattgcgccactgcactcaagcctgggtgacagagtgagactctgtctcaaaaaatatatacatatttttctaaaattttctaaaatagctgtagtctcagctatttgggaggctgaggtgggaggactgctgaaacctgggaggttgaggctgctgtgagccatggtcttgctgctgcactcctacctggtgacagagcaagactctgtctcaaaaaaaactgtgtacacttgttttagacataatgctattgcacatttaaatagtgtaaacataactttcatatgcactaggaaatggaaaaattcacgcgaactaaacccacagtatctctgaggtatgctataccttttactgtgttccgtgtttttgtggttatgtctattgtatctgcatggtggaagtattacagtttgatagtgtgcacctcttcccagctctgtgttcagtgatgttctttggaacatgacacagtaccacataggagtactttccccagggaaatttgaaaacaccacagatcagatctctgcctgctgctccctacttcaggctagttgttaaactttaccagcacacttgtgatgacatgacccttcaagttgactgacttctgtcagtaatgaataatcgaggcatcagttagatggagagtttacctttgtgaaacacttaactctcaaaaagaaatatttttgttacagaataaagcttgtaacacctagttttcttggtgttcaatgttttccttacttccaaattctctaaggtagagaaaggtaaagtctgactactggataaggggggatactaatacagtagttctgtggtctcaagtaaaagcgtaaaatattacatttgaagtagaactagaaaggatgctaaacaaaactgtgctgggcaaaaaaaaaaaaaaaaaaaaaaagaggaaaaggaaaggcaaatagctctatctaaccaaaattctattcatgtgagggagcaaaagatgatacaagaggagagtttcttctgacccccaaatcagctttttaatggatgaagctctttttgtccagagttactgaagcttctggatgttgttaggaatttaagttcccagacagattcagtaaaatactatagcagtccagagaaaaccaaataaacttgcagggagagggagggaagggaaattctaagtataaaagataaatctacagctaaggttgaatggctgttacaattaaatttttttaaaactaggagaaactgactaaggatttcaaatggaatagaaactgtcttacactttagggtctaaatgaaaggcatatacatttaaaatgtaaaagaaagaaatatatcatatgactttcttcttctttcttacttttttgagacagggtctcactctgtcacctaggctggaatgcaatggcgccatcatggctcactacagcctcaacctcacaggctcaagtgatcctcccacctcagccaccaccaccaaagagctaggactacagccgcttgccgccacacccagctaattttttttatcttttgtagaaacagggtttcaccatattgcccaggcttgtcttgaactcctgggatcaagcaacctgcccgcctcggcttcccaaagtgccatgattacagtgtgagctactgcacccggcctcatatgattttgaataaggcatttgctttatgctttacaaggtactagtagtaaaaactgtttagagtgatgtacataaagaacagttcagacacaaatgtaagacctgaagctataaaactactagaagaaaacaggtaaaccacttcaggacattgggtctaggcaaagattttatggctaagacctcaaaagcacaaacagcaaagacaaaaatagccaaattggactatattaaactaaaaagctcagcaaaggaaacagcagagtgaagagataacctgttgtatggaagaaaatatttacaaactattaatccaacaagggactaatgttgagagtatacaaggaacttaaaagtaaaacaaaaataaccccattaaaagtggtcaagcgatgtgaatagacatttctcagaagaagacacaaatgcccaataagtatatgaaaaatgtgtaatatcactaatcatcagaaagatgcaaatgaaaaccacagtaaggtatcacctatgacagagtggttattacgaaaataacagatgctggtaaggatgcagaagaaattcttttatactgtcagtgggattgtaaattaatacagcctctatggaaacacagtatttctcaaaaaactaaaagaactgccatatgatctgtcaatcccactaatgggtatttattcaaaggaaaagaaatcagttcaatgcagcactattcacagtggcaaagaacagaatcaacttacgtgtccgtcaacagatgaatggataaagaaaatgtgttacctatgcacaatgaatactattggccacaaaaaagaatgaaatcatttcctctgcagaaacatggaaggtactggagattattgtgttaagttaaataagccaggcacagaatgacaaatatcacatgttctctcattcatgtggaagctaaacatgttgatctcatggaggcagagagtagaatgatggttaccagaagctgggaaaggtgtctgggtgggaggggggatgaagagacgttggtgaatgggtacaaacatacagtgagatatggaacaaaggaatgtttaatagcagagtagggtaactatagctagtaacagtgaatgctttttgtattttaaaatagctaggagagaagacttgaaatgttcccagcacttagaaatgagaaatattcgaggtgatggataccccagtcaaggtaacaaaatagcccatatacctcataaatatgtaaactattatatatcgatttttttaaaagtatagcagtttgttacaaaaattagctgggcacggtggcaggcgcctgtagtcccagctactcaggaggctgaggcaggagaatcgcttgaacccaggaggcagaggttgctgcagtgagctgagatcatgccactgcactccagtctgggtgacagaacaagactcttttaaaaaaaaaaaaaagtatagcaatttggtattaaactggaaggaccaaaggacctaacaaataatctttaaaccagtcaatgccctatgtaacttgtttaccaataaattggacagaacagatggaactttagtgatacaggtggtttatttttaaatgaggagggaatacaaattccccaggagataacctctttctctaagaacataaagttttatgtaggagacagaacattctcatatgaaaaatacctaagaatatatgaaactaatatatgtaataggaagctattacatatattaatggtaacttagttgttcagtttttagttactgctgaacatcttgactatttaaataaatcactattttttccctaaccttgtccagatttctaaaactcagttactctcctaaccagtctacttaagtgaatatatttttccagtcatcaagactaagattcagtataatggagtcatctttgtctttcacccttccctttccttatgagtgtccatttctacttatttaggccttcaatgcatattacaccttaaattgtataacagtttatacattttaaaagattttcatcattatgtaatccctctgagttaagcagaagtgattaacatttcatcactcaagtatttattgagggcctacaaggtcactacaaggtgagtgacatataaataaggatgcagaatcaggcaggtcaaatgacttgcccaaggtgacaggatcagtgattattaccagtcttatgattctaatatcagcattcttttcattacactatgatgcctctcaactcatatttggtccattactataaattcatagtgggcttctctgcctctacttttccttctccagactatcttgcacatcaccattaaattaaacacagctttcattataatgtagcacaataaagaacttttcaatggtttcctattgtatagaggagaaaaactttatctctactttttacaggatatctctattaaactgtgatcctcatattcttttgaacatacttttacttttctaagagtatgcctttgcttttagcagtttaaccttctttgagtttcaagtccctaagtaatagttattaccgtagatctagatatttatgtaccaagcattatctatagactacatatatgcacaactaccttgtgtattttgactgagggagtaaagttttgatactaaaaaaaaaaaaaaaagagtcctctttgctgggtgaggtgcctcatgcctgtaatcccattgctttgggatgccaaagcaggagaatcacttgagaccaggagtttgagaccagcctgggcaacatagtgggaacctgtttctaccaaaacaaaaaacaaacaaacgctgggcatggtggtgcatgcctgtaatctcagctactcaaggaggctgaggtaggagaatcaattgaggccaggagttcaaagttgcagtgagctatgatgaggccagtgcactctagcctgagtgacagaaagcctgtcttaaaaaaaaaaaaacctcgagtttcacttctgataattaagaactcagtggttttgatcatacttctgctgtgaacaattaaaaaagctagaccaaaaccaaacaaacacccctgtttaaaggcacttgttagtgacaagttgtattttccactatcacaacaaagaaaaaggcaaaatatgtggcaggcgtctttagatttggagacaacaaaacatagtacaattgggtaagctgttcttagaggcttaactgtaactgtaagactaccagttttggccaggcgtggtggctcacgcctgtaatcccagcacttcgggaggctgaggtgggtggatcacctgaggtcactaaaaatacaaaaattagctggaagtggtggtgcatgcttgtaatcccagctactcaggaggctgaggcaggagaatcgcttgaacctgggaggcagaggttgcagtgagccgagatcttgccactgcactccagcgtgggcaacagaataagactccgtctcaaaattaccagttttgagtggggtagggcccagacttaggctttatgatcctgtagacccaatgatattagaagttaatgtaggagagatgttatatgaagcctctggcaagtttcagtgcaagaattacaacatagacccttaaggtttaggagtaaggccatatcttccttagccatgattttgtttcatttttttttttttatttgaaaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgtggcaagagtcctggaagtttttcaaggttcatcttgcaccttctagcatgcatatgtcgtaccaaagcatgtagaatgctgcctacttctgctcttcagtttcatttaatataatttcattactctgataaatcagtgtgatgttctatggaataacaaaagaccgtcaaggtcccttcataccatatagagaacaggagagttgatgtagcctgagacaagacagtaaggacttactgttatccctcctatttaaacgtagtctgtttctgattctccttagaatgggggtggggggacatttccagatcaatatcagatcagtatcgtgtcaacatgggtattaatttcttccgaagaagataccacacctagaacagcaaccataattggcatccctacctaattaaagtttgcagtccactgtcattcttcactagccatctggtttttatattgtcattctctatgatgcatctggtggccacaggaaatttaaatgggaatgtggtatgaatcaccatggcagcatggtggcactaatctctgcaattcttttggtttttctattttgcttttttatgttttgtagaaatgcagtcttgccatgttatataggctggtctcaaactcctggtgtcaagcaatcctcctgccttggtccccctaagtgctggggttacaggcatgagccactgtgcctggccaatctctgcaatttcctcagggatatagccctgcttttcctttactatcttaatgaggagtggtagaaagcagacctaagctgctgtgtagcactttctaccataatagcaatccctccattgatcaggaaaccaaaataaagattgttgttaaaagatacatattaccactacacatctgggactggagaaatagccacagtatgggtccttctggatctactgttagccacagccaggccaagattccatcacttgacttccttaggttccctattctgaccagttgtccagggtagagttttgggtttctagtattagtacaagttaagagacagtgccttaagaattctagccagcctgggccgggcggtgggtcacacctgtaatctcagcactttgggaggccgaggtgggtggatcacgaggtcagcagatcgagaccatcctggataacatggtgaaaccctgtctctactaaaaatacaaaaaaatttacctaggcatggtggtgggcgcctgtagtcccagctacttgggaggctgaggcaggagaatggcgtgaacctgggaggcggggcttgcagtgagccgagatcgcgccactgcactccagcctgggcgacagagcaagattccatctcaaaaaaaaaaaaaaaaagaattctacccagcctggccaatatgacgaaaccccatctctaccaaaaacacagaaactagctgggagtgatggtgcatgcctgcagtcccagctatttgggaggtagaggttgcagtgagctgagattatgccactgcactccagcctgggtgacaacagagcaagaccttgtctcaaaaacaaaacaaaacaaaacaaagaattttggatattttcctttctctagtgaatggtcactggtccctatggaaaaggcttagggcaatgattcccccaacatatctgctcactggaagtatctggggaacttgaaaaaatactgatgcctgggtcttccctgagattactatttaattagtttgggttgtggcctgggctttagaatcctaaggtgttctaatgtacagacaagtttgagaaccccactggattagggaacaattcgttgtatacagctgtgattgcattgcccctttcgtcaaaggatccagtctctttccatcagtgaaggagtaccaagtctgggagctagatgagatgcttcaaattttactacaaaaccacaagaatttttccacctatatatgtcaagcagcaccttggtaggttactttattatatttccagggacctcatgatcatttagccattatcacttttccctgtgggtcaaactactctggttaacgttctctcctttgacttattttggtaattgtgcctactttgtctctgatatttatttatttatatttttatgttttttgagacagagtcttgctctgttgcccaggctgagtgcagtggtgtgatctcggctcactgcaacctccacttcccaggctcaagccattctcttgcctcagtctcctgagtagctgagaccacaggcatgcaccatcacacccagctaatttttgtatttttactagagatggggtttcaccctgttggccaggctggtctcggactcctggcctcaagtgatctgcctgcgttggcctcccaaagtgctgtgattacagacgtgagccactgtgtctgtcttgtctctgatatttatatgccattatgtggcctctactgccttaggattctaatgttcccactaagatcagctaactcagttccactacagggtttaccaccatcatctctcgcaaacaaagacagccacttcagagctcctaggaaatagtggtgctcccatcatcattgcattccttaatgacatggtgaaaattaacaatggctaaggagcctttgtgttttctcctctacaatatgcccaggaatttctggcattttggccatcttatttataggctattactgaatttaagcctcatcctaccaaattattaatgccaaaatattaactcttgattcttaggtgagtgcacccatgccaataaatttgccatgatctaaccttaaatgtattctcatatatgctgtccaagtttctgctgattaaaatggcaaggcctttagttctcctacataggttttctctctccagagaaggcctcaattctctgactaggctatgttgggatataactggaggcactaataggtagtagggtaaattctttattttattatttttggagacagggagggtcttgctttgttcagactggagtgcagtggtgtgatcatggctcattgcaactttgaactcctgggctcaagtgatcctcccacctcaaccttctgagtagctgggactacaggcgcaaaccaccatgcatggctaattaaatttttttttttttttagagacagagccttgctgtgttgcctaggctagtcttgaactcctgggctcaagcagtcctcccacctcagcctcccaaagggctgggattacaggcatgagctaccatgcctagccccagccggtaaattctgaggagagcatgtatcagcttgtgaaggagcttgcccaagtgcaatcactgaaagcctctatgcataggagcctggtttcctcagaaagagatttaggggaagattgatgttcagagttttcagcttcatttttctctgctcaaatgtccctatcgtatgtcttaggactcctctccccaccaatgttccagcattagaataggaaaggggaagaattaagcatgtaattgatactacaaatctaccatatctgcccagtgattacagaagataatcaactccttcagacctgtaatagagttctcatgctccacatacagtcattttctttttgttgttgtttatgatagtgtctcactccgtcgcccaggctggagtgcagttgtgcaatcaaggctcactgcaacctccacctcccaggttcaagcgattctcatgcctcagcctcccaagtagctaggactacaggtgtgcgccaccacacccagctaatttttgtattttttcatagagatggggttttaccatgttagtcaggctggtcttgaactcctggcctcaagtgatctacccacctcagcctcccaaagtgctgggattacaggtgtgagccaccgcacctggtcaccacatacagtcttaattgtagtttttatgtttttctttttcttatgtatttttcttttcttttcttttcgttagagatagggtcccactctatcacccaggctggagtgcagtggcatgatcatagcttacggcagcctcaaactcctgggcttagacaaccctcctgcctcagcctcctgagttgctgggataacaggtgtgtgccaccatgcgcagctaattaaaaaaaaatttttttagagatggggtcttgcagtgttgcccaggctggcctcaaactcctggcttcaagagatcctcccaccgtagcctcccaaataggggactacaggtattagccaccatgccccttaacccacgtatgcctagcgttccattattggaacgctaagcatgtgggaattatttatagcctactgctcaaggtcatcgccaaggtctgatttttcactcatgcaaaaattcaaaaaattgcaacctctggcacaaacgggttaagtactttctgtttcggaccataagaaaagccagatggatctataatctttataattaccatggttatcatggtgatacactcctcacctgcttcacttgatttcatgttgttactggtaatcctaatacaactgcaaactggctgggcacagtgactccttcctgtaatcccagcactttgggaggcaaaggcaggaggatcattggagctcaggagttcaagaccagcctggacaatatagtgagactctgtctctacaaaaaaagaaaaataggccgggcatggtggctcacacctgtaatcctagcactttgggaggccgaggtgggtgggtcacctgaggtcaggagttcaagaccagcctcgccaacgtggtgaaactctatctctactaaaaatacaaaaattagctgggcgtggtggtgggtgcctgttatcccagttactggggaggctgagacaggagaatcgcatgaacctgggaggcggaggatgcagtgagccgagatcacaccattgcactcaagcctgggtgacaagagcgaaactccatctcataaatgaataaaaaataaataaataggctgggtatggtagtgcacgcctatagtcccagctatttaggaggctgaggcaggaggattgcttgagcctaggaggttgaggctgcagtgagctatggtcgcaccactgcactccattctgggcaatagagtgagaccttgtctcaaaaaaaagtaaactaaatattgtaagccatggattacctgtagtctgtagtctctttccttataggaacgaggttattcctctgattgattttatgtgtgcctgtgtgtgtgtgtgtgtgtgtgtgtgtgtgtgtgtgtgtccaacccaatctcaaaatcttacttaagggtccatttcctgtaataacttctgttgcaaatcaccatatctttagagtcttaagaagaaatagaggacagattaaaaataatttaagaaggcttggcatggtggctcatgcatgtaatcccagcactttgagaagctgaggcaagaggatggcttgagcccaggagtttgagactagccgggacaacatggcaaaaccccacttctacaaaaaaaaaactagctgggtgtggtggcacacacctgtagtcccaggtacttgggaggctaaggtaggaggatcgcctgagcccaggaggttgaggctgcagtgagccctggttgtgccactacactgcaacttgggtgacagagtgagacccctgtctcaaaaaaaaaaaaaaaaaaaaaaggaaatatactggtaaaatgtattacattaataattttgtttatcaaggcaccattacaaaaagactaaccacaatgtaagaaaagatactggccacacatatatttgaccaagaactcatatccagaatatataaatgattcctaaaaatcagtaagaaaaagaatgacaacccaacagaaatatgggcaagtgactttaacaggcactacagaaaagatctccaaaatgtctctgaaggccatttttgtcaaaaacaaaaacatctccaaatgttaagtaccataaaatggtgctcaacttcaatggtcatcaagtaaaaggttaatgtcaaaatgagataccactacattcgcatcagaatgaccaaattaaaaagattgacaataccacgtgttgaccacagtgtggagaaagtgaaactttgtcacactgttgtggagcagtgacaggggacgggggacagggattgggtaaagtttccataaacttggaaaactgtcattctttacaaaatttgaaaatacatcaatgactaagcaactttaatcctaagtatatactcaacagaaatgtcttcacttgcatgtgaagagacatacagaagaatgcaccataattggttaatagctttaaagtggaaacagcccactgaaatatcaacaataaaatggataaatatattttatccatttaatagaatatagaagtgaatatgaacaaacgataaacaccacagatcattttcagaaatataatggtgaaaatatacattacataatttcattcatgtaagactcaaaactaggcaaaaatgatgtatggttagaaatcagaagagtggttacatttggggaacagtgacaggatagttactgggagctctcataagaaggtttctatttcctgggtgctggatacagggacactctgtgataaatcactcatttttgcatatatctatatttcaattttttaaaagggtggtccttaaaagattatgatttagggtttaccaccttgcccctctccatcaattcaaatatttcttccagttcagatcccacaccttacatgaagcctttcccaaccatttcagccagaaggaatttctctttcttcctggtttttatgccatgttctctgggaggtagtgtaatatagtggaaatagtataggctaaggaacttggactttaatctgtgtggcaataaagagcagaagagtgactcggtcagacttgtatctacctaccacaaatttaaccaattttacttatatttctctgtgaacaaatatgaaaatttatacacatatattaaatataaatatatagcttttataccacggaatactactcagccataaaaagaaatgaaataatggcattcacagcaacttggatggagttggagaccattattctaagtgaagtaactcaggaatggaaaaccaaacatcattatgttctcacttataagtgggagctaagctatgaagatgcaaaggcttaagaatgatacagtggacttgggaactttgttgggggcgggtgagaggggggtgagggataaaagactacgcattggctacagtgtacattgctcaggtgacaggtgcaccagaatctcagaaatcatcactaaagaacttatccatgtaaccaaaacccacctgttccccacaaactattgaaataaaaatttaagaatacataaaatgtgtaatttgtgagattgttacaatatttgccctcaataaatcatgcctactttgttcatgcatctttgcaatgtgcttttgccacttttcccatcaaaggctttatttccttaccccttgaatctagctatctttgtgacttgctttgaccacagaatgcaaatagatgtgactttgtacaacttcttagactaggtctagagaagcttcacagcttttttcaccgtttggaacactgcactgagaccactatgttataaatctgggagtgaaagacagtgtaaaggcagccacaggagtgaacacaggggagactaacagaactttctggccaaatcacagtgtggtgagagagaataaatcatgttgttttaagccactgttttggaatgcatgtgtaatgcagaagtagataatttgtaggaaacagagtcccttttccattacctagctcacctatttactctgttgtggcagagaatacaattatttcccaatgtcctttctcctcttcttcctttaatattagaacccccatttttttttgttttgttttgttttttgtttttttttttgagacggagtcttgctctgtctcccaggctggagtgcaatggtgtgatctcagctcactgcaacctctgctgcctgggttcaagcaattctcctgtctcagcctcccaagtagctgggactacaggtgcacgccaccacacctggctaatttttttgtatttttagtagagacggggtttcacagtattggtcaggctggtctcgaactcctgaccctcaggtgatccacccacctcagcctcccaaagtgctgggattacaggcgtgagccaccgtgcccggcagaacccccatatgttagctgggtacattgctacatggatagtgactataatttcctaactctcttgaaagtttggccatgtaactaggttttggcccatgggtcgtaagtggaaatggtggctccaacttctatgatacgcccttagaaagaagaggtatactcttttactatttcctgttctcaaatgtatcatggcaggagctggaactaccaccttaggccatgaaatagaagccacatattcacatattgagtagatcagattaaaaagctaaaagtagcttgagtacctaatatccagagctgctctatcagtcctgaaccgattatccttggactatgagagaaaaagaaatttacatcttatgtcattactattttgacctgagagcaagcaaacctataatcccaagtaatatgtgtttttcacattccctcgtatatatatgttcatgtatatatatacatttacaaatataaatatccatatgtgcacacacaaatatgtaaacatctctataggtattggtgtattttgttttacagattgagatcctgcacttttctccatctttttctcatttagcaatatctggaaatgacaactcatacaacttgaattcattccttttgatagctgtataatattttataggatgcaggagttgtaattcattctgctgttttcctactgattagctttcattttgttacccttttttccactatgaatatttttgtgaatagaaccttatgtatttctatagaacagattcccaagaatggtacagcaaggacaaaagatatctgtagcttaaaaaattttaatacaggttgtcagactgttttacgaataagttgaaaaatttcacatttatgccagctatctataacaatacccttttacttggacccctcaccagccatagttgctattggtcatttaacatttttcccagtctgaaaagatgtttcacctcacttgtgacaagagaaatgcatagtaaaattttactgagattaaacatttctgcttattagtcccaaatccaacagtttgaataacatactctaataacaatgctgtgggggcactctcatctgtttatacagcacctatggagagaaatttggcaatatctgtcaaaattacacacaaacacacacatctttttttttttttttttttttttttttttttttgagacggagtctcgctctgtcgcccaggctggagtgcagtggcgggatctcggctcattgcaagctccgcctcccgggttcacgccattctcctgcctcagcctcccgagtagctgggactacaggcgcccgccactacacacacatctttaacttagcaatctcttttctgtgaatttatccagcagatatcttgaacatgagacaaaattatgtacattattattcaatgatactgtttttaaaagctgaagactgaaaacaatgtccatgtccatcataaggtctagtaaaataagttctggcattcatgtagtggaatactaagcagccattaaaagataaggaatctcattatggagttacataaataattctaagatatattgtaaactaatatatgtaggacagtgtatatattgttatctttatttttaaaatggagaataatataaatttgtatttttctgtaaaatatctgggaaggtatgcaaaaaactaataaaagtattaatgggataggtggtggtgttatgagaaattggtgaacaggagatcatgggagactgaaacgcaaaacatctgtctctctctacacatacagtatctgaatgaactatctattcaaaaaggaaagaaaaatagctcctatagagtgaattcaatttcgcctactgtgagttttatgatcctcactttcatcaactgaataaaagggataagatccacttcaaagtactttctgaacactaaattagaggtgtgcttagctcagtgtctgtccatattaggcactcagtaaatgttagttgaattaaaaaaaaattgtcagtctgttagactaactggcatcttattattttaattttcattttcctgatttctcctgattctgagcctcttttcatatttggatttattattctctgaattcatattatttgcccatccattcttctgttgaattgcttgttcccttgatgtgaatttctgagttccctgattaaacctccttgcaaatatttttctaaatttgttgtgtatctattaatttcgtttagattttttttgcaaacaaatgttatttttatattgacaaatgtgtatattttttaaggataatgtatattctgctgttcttacatgaagtattctataaatgtcaactagatccagtagattaatgatactacagttcaatttttactgattttctgcctgctggatgaattattgaaagagagatattgaagtctctgtgatactggatttgtctatttctcttcgtggttctatcagtttttgccttacacattttaatgctgttaggtgcatatatgttaaagattgttttatctttttggagaatttacctctatacttatgtaatgcttctctctatccctgacagttttcctttttctgaaatctgctttgtctgacaatatagcaactccagctttctttttattagttttagcatggcagatctttctttatttacttttcacctatctatgtctttatatttaaagtgagtttcttacatatggttcctgaaaaaatgaaaaactagtaaaggctgttgtcttcctccctccaaatcaaccctgagtaacaacagaaacaagaaggaagcaaaagcttgaggaataagatcaaaaacttaagaggaaaccatagttagtgttaggagtaagttctgaaatactgttttgccatgccccactttgctttgggacaatcagtgccaaactactgattgctacagaaatcaccagcaacagatcaggcttcctgtaggattagataaagggtctgttgaagtgagttgccaatgaaaaagtggggctgaccagatactatagaatattggggcattcacccctccactccttccctgctgccagaattttgataaattataacagccttctgctgctggattgtggatttcaacacagatccttactagagaaacagtagcaaagagagagcatcagttctgtggttgcctacagctcttgctttctgctccttaaacttgtgggaagggataaaaacgagggtctgccattttgctctacctttctatccattattagaaggggtagtagataacactaggagaacatggcttgtgaaccaaaatatctagacacctgaggagtatgatcactatcaaacacaacaaattctacaacatgtaccaacagaagtagaataataggatataccaatacttttaataactcaattattcattcaacacaatttgtaaagatacagggtctcactctgttgcccaagctggagcaatcatagttcacttcatgcagccttgaactcttgggctcaagcaatcctcctgcctcagccttcttgctagctgggattacaggtgtgtgccaccacacccacctaatttttagaatattgtttatagagacgaggtcttgcaacgtttcccaggctgcttcaaacacctggcctcaagcaatcatcctgccttggcctcctgaagtgctgtgattacaagcatgagccattgtgcccagttcattcagcagttttttactgaacacctaccaagtgtcaggtactaaggattcatcagtcaacaagataggtaaataattttgttcatgtgggacatggcaagggggacagagacaaaaagatacaaattaactaaataataaacaattttggaaggtaatatttactaccaaaacaatgcagagtaggtagattgggactgatgaaagggttgccattttaaaatgaaacccatcctaaaataggagccacaaagatgcagggttgcggtgaggctggtaatatgtgaagagtgaacaagaaaccataaagccatatgagattattaggtgtggaaaaatatgagctaaaataaggatcatagctgggcatggtggctcatgcctgtactcccagcattgtgaaaggcctaggcaggcaaatcacttaaggccaggagttcaagaccagcctcgctaacatggcaaaactctgtctctactaaaaatacaaaaattagccaggcatggtggcacaagcctgtgatcccagctactcggaaggctgaggcaccaaaaatttcttgcaactgggaggcagaggctgcagtgagctgagattgcgccactgcactcccgtctgggcaacagagcaagacggtctcaaaaataataatgaataaaaaattaaaaaataaagaacatcatagataaatagcaggtggattggatcttatgatgcttttgagatacagaattttaatatttttgtgcagttaaaatctctagaacttttcctttgtgctttctagtgctttcatgctttgaaaaaacctttttatccagagatatttttaggttgataattaaaatatttaaaatcataatattcgtatatggaaagaaattcaaacaaaataagatactagaaagtaaaaggcctcatctactgtctctcctcctttcctcagaagttatcatttttctaggtatccttctagaaatgttctatgtataatcaaatacatgtaatttttaaaatttataaataggatactatacatactttctacaatttgcttttttcattcacacatatggccctactccagagattgaggttttaaatatcaggaagaattttatttagaaggcaaaactacagagacaaaagataattggttacccaggggtataagttaggtaggggtaaataggtggagcatagggcacttatagggtaataaaatgattatgtatgctactattatggtggacacatgacactatgcagttgtcaaaattgatagaactatacagcacagagtgacccctaatgttaactatggattttagttaataatgtagcagtactggttcatcagttgtgacaaatgtaccacactaatgcaggatattaataggagaaatggtgtgtgttgggttagagggtgacatatgggaatctgtattttctgccctgttcttctgtaaatttaaagctattctttaaaaagtctttgaaaaaacttcatttagaaaaactattcttaaagctttgtatagaatattttaaagttggaggctagaggtcacatatctggtagactgttgctatggcccaaacataaaataataaaggactatactatggtagcaaataaaattactttgaataggtttgctaatacctaagaaaatttcacattagaaattgagtggaatttaaagtttctaatataaagaaatcatgtgtcaaacatagtgttaatcaaaaataggaaaaaacaatatgcataaaaattatgagaacaaaaggaaatgtggctgaaaagatgctaatagccataacatgttgaatatgttgtttctttttaaagttaacatgacacagaggaaccaggaaatgcgtctactgcatttagttttatttatgttcttaaattgtttatttccagatttctgtaacatgtatatatatttttaaattcaattttattttgtgtgtgtgtgtgatggagtatcactccctcgcctaggctggagtgcagtgctgcgatctcagcttattacaacctctgcctcccgggttcaagcaattcttctgcctcagcctcctgagtagctaggattacaggcatgcaccaccacgcctggctaatttttttgtatttagtagagacagggtttcaccatgttggccaggctgatctcgaactcctgacctcgtgatccacctgccttggcctcccaaagtgctggggttacaggcatgagccaccgtgcccggcctgtattttcttaaaagatcagccattaccaagttattattggatgcctttaatctcttttgttagtgtatccatattccaataaaaatttatttataaaaacaggcagtggtctgctctataggatcttgcactaataagttactttaattctttaaggttgtcttgagaattaaaacacataatgtacaaataaaacaccatgatttggcatatagtaagcacttgaaaatagtagtggctattttattaaaatagtgtgttatcatacagctcaaaatgctgataagatgaatctgaaattcagacttaaaagtatttttattatagtaacaaggttatatttgggattttaagttttgttctaccaccagtggtagtttaaggcttcttgtataacggttctttgtgatgtttttcttgtcagagacacgtgtgatgaactcttgggacatgttccactacttggggatcctggtatttccttgctcagttttcacaagaaataggtttggcatctctaggagtatcaaatgaagatgttcagaaacgacacaaggtgtcgtttaaagtttaaagtcattttcgactttaaaaaatattctattgatatccattaataatgtagtaaaagcttccaagttactataaagtaatggttctggaaagagcatgttaatttaaaaaaataactactttaggtatgattgacatgtaaagctgtatatattgtatataatacaattagtttggggatacattctaatcatttatgataataacaacttagatctcatacaaaaactcgacactttaactcatctgtcctctcccacattgttatcgatgtcaaaatttacatttttatattgtgcatcaattaacaaattactgtagctatagttatttttaatacttttaactcagagttaaaaatgattttatgtatcaccattacattacagtattctgaatgtaactctatacttccctttaccagggagtttcatactttcacgttttcatgttgctaattagcatcctttagtttccacttgaagtacttcaactttagtttcagttttagcatttcttgtgaggcaggtctagtggtgatgaactccctcagcttttgtttttgtggaaaagtcttcatctttccttttctgaatgacagctttgtgggtaaattattcttagttgggaggcttttcttttctttcagtattttgagtatatcatcccattctcttctggcttgcaaggtttgctgaaaaacctgctgaaagtcttataggagctcccttgtacatgacaagttgctttcctctgctgctttcaaattcttcgtcattaacttttgaaaatttgatcacaatgtgtctcagtgaaaaaattttcatatcagacaggtaatgtgccagtgttttggcaaggtctgagaaaggcacatcttacacaatggtatgaaaacccaatcatcatgcttatgaaccacaaaaagatcaatgaagacatctttatgttcaacctacatggaattctttgggaattgtggatctggatgttcattttcctccccagatttgggcagttttctgctattatttctttaaataagcaatctgcctcctttctctttctctgcttgctctaccacttctataatgcgcatattggtttagagtcctgtaggcttactttattatttttcctctttgttcctttgactggataatatcaaatgatctgtcttcaagttcattgattcttctttctgcttgattcaatctgccactgaagctcacttttgaatttttcagttcagttattgtgttctttagtttcagaatttgatttgtttttttttttgatatggagtctcgctctgtcacccaggctggagtgcagtggcgcgatctcagctcactgcaagctctgcctcccgggttcacaccattctcctgcctcagcctcctgagtagctgggactacaggcacccaccaccattcctggctaattttttttgtaattttagtagagacggcgtttcaccatgttagccaggatggtctcgatctcctaacctcatgatccacacgcctcggcctcccaaagcactgggattacaggcgtgagccaccgcgcccagccagaatttgattgtttagtggtttctttgttgaaattctcatttgttcatgtattgttttcctgatttcgtttagctcactgagattcaaggtgagtgttctgaattctttatcaggtaatttataggtctctgtttctttggggtcaactgctagaactttaatttgttcctttggttgtcatgttttcttggtgtgtgtgtgtgtgtgttcaactgctagaactttaattcctttggttgtcatgttttcctggtgtgtgtgtgtgtgtgtgtgtgtgtgtgttcttttaagccttgtcttctaactttgcatctgaagaaagagtcacttcctccagtctttactgactagcttcagaagggaaagacgttcaccagtcagcctgactagagattctgaaggtctctcagaccttttctatgatatgcccattccattcctcttgttctgtcttgggaggggaagtcttaggattgtgtgctttctttcaatctcacaaagctagactatgtgctgagaacctccttttattttctctagtgcagtgcctcagagtgttcaaggttgtgtgctttcttccaatccagcaggagccagttgctgatatctgtgtgctatctgctggggcctgcatacactatctgcaggggaggttgggctgctggctagtgggtgggtgcatggagtgctgggtgtgcttgtcagttgaggggttctgcaggtgaagtgtcctgtagggctcatgggtgagcctatggtggagtctgcaagccagttaggagactccacatctagctctgaagaatcatgtgttggttgctataagcctctgcttcttttcccttctcctagatattcctagactattcatctgtgaagagtccctcagtattctggatagggaaaaacagaagtgagccttttgggcggcaacacgcaaggctagggaagctgggcactcacttgactcttactttccttcctgggagaactcatgggccaaaagggcctctcttggcactgaactctgctgccttggaggagaaggatgtaggtaaagtgaaactgtttttcttaccctcttcaatgtgtctattcttgagtttttcattctactggggtgctggaacctcttagcaggtctcccaggctcccaaaatggtatttggtatttctgcaggggtttgagggctggaacctactaatccaccaacttgctgatgtcagtcagggtgcctttaatctgaatagtattatttcacacagaatgctatctctgagtttagtagctcagaggcaaaatataaacagttaaatatataaagtaacattattaaatctcacatttattctgtgcacaactacaatatcgcaaagcattatgcaggttccttcttcatgcctagttcatcggtgcttggagtagctagttccataaacttctgaggtaataagaatctgccttgttattttattatttaatgactatatttatagattacagtaaccatggaatttctaaggcaaaaaagatggcttccaaaatagcaaaagaaacttcaaagatctatggaattaagcttttaattatgcacatatgcatatacaattatgtatatcatatatgtgctttgtaaccataatcttttgtctagtcaatgactgcaaaagtggtatgtcagtatacacttacagaattatagaaaagagaagctttcttcagagctcactctattctatcatgtgtttgcttgtttatttatttattatggattgactgacagggtctcactctgttgctcaggctggggtgcagaggcataatcatacctcactgtaaccttaaactcctggcctgaggtgatcctcccaccttggctatatagataattctatatactgttagtttttagtaccacaaagtgttatggaaggtgatttcaaaatagtttcgccatgttattgatttatagatcccagttttgtttctttagttttccatttatttctagtttgctggacttcctcttaaaactgtggggttaaggcaaggcagttccaaatgtagttcctcatacacaaaggggaagtaagaacaccaaacaccaaaatcaaaatgttctaataaaaaaagtttatctctttaaaatgttgaatagacagatttaataataattcttttttaaaaaaaattgattagtttctcatatgataatcattattttaaccccaacctatagtccactgtaagtatccttttaatttgttaaagcatattagttgttccattaatttcatctacttttccaatccatcaatctgtgattccttttacctttctcttattttgggtttcttataccttgatcaaatgtcctactttttcttagtttattcctcatttaggtggaacacatcctctattagctttctgagaagagaatgcgtagattgtgtattttttaaaccttttaggtttgaaaatgagtttattgtagtttcacaatgggttcttggtttggattggtatagaattctaaattataggtagtttttcttcagatattttaagaattgccctttaactaccagagctactgttaagaagtccagtacatttaacttttgtagtatgtgtctcagtctgtttgggttgctgtaaaggaatacctgaggttgggtcatttatttaaataagaggtttatttggctcatggttctgcaggctgtacaagaagcatgatgccagtatctgcttcttgtgaaatcttcagactgcttacactgagggcagaaggcaagaggaacccatgaatacacagttcacatggtgagagagaaaggccagaagtgaggggtatgggtatgcccaggcttctttgtttttctttgttttttttttctttttttgagacagagtctcactctgtggcccatgctggagtgcagtggcacaatcttggctcatagcaacctccgtctcccaggatcaagcgattctcctgcctcagcctcccaagtagctgggattacaggtgtgtgccaccacacccagctaatttttgtatttttagtagagatggggtttcactatgttggccagtctggtctcgaactcctgacgtcaggtgagccacccaccttggcctcccaaagtgccgggattacaggcgtgagccaccgagcccggccccaggctctttttaacaactacctctcacaggagcgaacagagtaagaactaattatcacaaggactataccaaaccattcaggagggaaccacccctatgacccaaacacctcccactaggccctaccaacaacattggggatcaaatttctttttcttttttgagacagtctcactctgtgacccaggctggttgcagtggtacaatctcagctcactgcaacctccatctcccgggttcaagtgattctcatgcctcagccacctgagtagctggggttacaggtatgtgctaccacacctggctaatttttgtatttttagtagagatggggtttcaccatgttggccaggctggtcttgaactcctggtctcaagtgatctgcccagctcagcctcccaaagtgctgggattacagacgtgggtcaccgtgcccagctgggatcaaatttcaatatgagacttggaggggtcaaacaaaccacatctagagaaagagctccagaaatctgcatggggttccttaagcattttatattaataacaatcttacatactcaatagccatgttattagtattgacacattacataattacattgatcatgtagatctagaccaaccactgtgaaaaaaacaaggtgcagctaataataaaaaagatgagttgataatgaggtaaaaaaaatgatgaagatgaaatatcatactaactatgcatgtatatgtgccaggtactgttttaattgctatctatgtcttaattcagtgaatatacacaacacaaccttaagatgtaggtattacctacatttttacaggttatataatttatcctagtagaatcagaattgtagtctaaacagtgtggctccaagagtctacagtcttaactataatgctgtatgtaattccttgcagtaagtagacagtagtagtgttttgttatattgttattaaatgccctttcttgaccaaataaaaaattggcaaacctatcttgacttcccaatttaaaaatttattggctgatgaaatctaaaagcctggaaatcatcaatttatagggccagtaaagaacaaaaaaaattaaaatttgagaagtaactgatggagcaaggtcttaaagggattcagctctagaatacagggagcagttagatttggagaacagaacaaaagctaaatatagaagggattatgaccaagtagagatgatggtgagaaaagcttctctagtaactaaaaatcaaggtcatctgagctcaaaataagcctggtaatgttaatagaagacataattattaatataaaatagtgaagatttgaacaacttttgtcaggaatgagaaaaataaataaatccaggaatgggctgacagagcagaaaaagacagggtttcaaaactaaatcaaagaatgtttagtggcagtaaaaatgtaccagaatgtgagattgtggtcaccagtaaaattgctgaatttaaggtctgaaagccagagtaaagggtcattcattgatggtaaagacgataatgataataaccattcattgagtatattacaaaattaattgtatctagtcataaccactggtatcaccatatcaaagagaagaaaactgaggccctaattaattttcagtaaaaagttaagtttttcatacaacttgacaagaggactctgaaattcacagagtagtaacaaggccaggcattcacaatgcaatttgaagaaaacaggtggggaagcttatcttgctagatattaacacttacttatatagttgtagcaattatgacagtatggtattgttatagaggttatacaaatacagcaatggaagagaataagcaacccaggatgtgtggaaacctgatttgagataagtgacattacaaaccacaaaaacaagtttaactcttcaataaatggtgctagaacatagttgtttgtatgtaaaataataacaaatgagagtagatccctttctcatgcacaaaaagtaagtactgggttgagtaaagccctaatatgaagaatataagtttaaaacttttagcaaaaacacaggtgaatacctttgtgatttaggggtagaaaaagatttcttaaacaagactcccagaacacaaattgtaaagaaaaagatgaataaatttgactacacccaaaccaaatttcagtataaaaacagacatacacggtcaggcacggtggctcacgcctgtaatcccagcactttgggaggcagaggcaggtggatcatgaggtcaggagttcaagaccagcctggcaaatatggtgaaacctcgtctctactaaaaatacaaaaattagccgggagtggtggcgggcgcctgtagtcccagctacatggaaggctgaggcaggagaatcacttgaacctgggaggcagaggttatagtgagctgagatcgcgccattgcactccagcctgggcaacagagactctgtctcaaccaaaaaaaaaaaaaaaaaaaagacatacactaggagaagataagcaacaggaaaagataagcaaccaatgtaaccaacaaggtaatattttccagaaaacatgtaccagtgaaactgatgaacaaaccaatagcacagtgggcaaagatgtcaagagcagactagtaggcatttggaattagactcctagaattaagattagcctaaagaaatctgggctggaaatagagatttgggctatatcttaacgatcatatttgaatttggggcactggatgacctaatgggaaaaaaacatgaaagaaataaaagtcttgggcctagctaggacaggcagaagatgagtgatccaagctcaagtgcttgaaagtaaataatgactcctttaactgtatttacatatttatcttgagttttctgaccacagtttctttatgtcttttaaagatggagtctaaaaacactatcgcataaggtggtcagataagcctattacatctatttagagcaatattatctttagaccatgtttcatgtgcagccaagaaggcagggttgtggaaatgaaatacaaatataaatgaaaacaggatttaaattttaagtaaagggaatttaagaaaatattccttttaagtggataataaggatttttaaattggtggagttaggaattatctcctattacacattcgcatagctcatgtaatgcatcagaatacctaatatatgatccacaccttttctctgaatttcaaggcctcccaaaaaagttttatccatatagacttgcattcactacattttttctacttgaaaatagcaaaccagctattcacataaactgctaagaggaagtaagccaaccataaaaaattacatactgtaaaattacttatatgtgagggtcaaaaacatgcacagcaatacagaatagtagtaatggtggtggatgtggttggaagggtcgctttttaaaaacgcctctattgaacattctgtatattgatgtgggtggtggttacctggaactgtacatttggcatttgagcattttactatatctttaaattgaggtatgtattttttaattctttaaagaaaaactgcttggaggtcttattcttaatgcacaacaatcacaaacattaaatttatacagtccagagaatgtaaagttgctttaaaaaaattctttccttttctcactttaaaataccaaggggaaaaattaaactcaacacagcacgtcttgcccttgtcaagatgacagatcctctaagagaagaaacgaataggtaatggccttttccagattttcttttcctaatgtaccccacttccaacctacccctacctcaactagggtatctagttgtacccaagggtgcttctacattagatccacagagattaaagataacagttaacagaatagtccagaggacaaggatattcaagttccatcatcttcaggataaaaaagctccagggtttacctccaaactctctctaaaggaaatcccatcaaccttttaaacatcactttgtatacaccatcttctgtactgccctagctcaaaaacatgaacctgtatctaaacgtgtttgtagaatttccattgtaagttttactttaacaattttgaacaattataatgatagaaaattatttaatctagattttggtcaactctattactgatattcttttttagtgaaggacaatcacaaacactaaatttatacagtccagagaatgaaagattgctttaaaaaattccttccttttctcactgtaaaataaaaataccaaggggaaaaatggaaagtatttattataactggctgttacactgtcatacacaatgaaatactggaccattagcagttcgttattatatgttgttaagtgtagaactgtaaataatgaggcatattattaagatatcacacacattatccaatcagcaagtgcacaacttcggacattttgacttcagccaaaatatgaaacaaagtcatagcaagaaagttatttcaagggagtgaaattttctcctcttacccttcaaatcttttagagatattaataaaaacaactatccagcctgggcgatataatgggactccatctacatacacacaaaaatttttaaaattcgttgggtgtggcagcacacgcctgtaaacccagctacttggaaggctgaggcagaaggatcccttaagccggagttagagtctgcggtgagctatgatctgaccactgcactacagcctgggcgatagagcgaaaccttgtaacaacaacaacaacaacaaaattaaaaccttcaagatcaagcttgcccaacaggatggctttgaatgccactcaatgcaaatctgtaaactttcttaaaactttatgaaaaaaaatttttttttagctcattagctaccattagtgttagtgtatttatgtgtggcccaagacaattcttcttccagtgtggcctagggaagccataaggaccccctgcgctagacttcagcagaagccttgtaacataaagaaaaccatacataaggctttagattctttttttttttttttttttttgtgacggagtcttgctctgtctcccaggctagagtgcagtggcacattctcggctcactgcaacctccgcctccctggttcaagcgattctcctgcctcagtctcccgagtagctgggacaggcacctgccaccgcgcccggctaatttttctatttttagtagagacggggtttcaccatcttgacctggctggcctcgaactcctgacctcgtgatccacccgcctcggcctccctaagtgctgggattacagacgtgagccaccgcgcccggccagctttggattcttttaccactttcccgaaggaaaaggaactgaaaatatctaaggaaggactactacgaatcttctctgagtggcaaaaaccagaggtttttggagctagggctgcagttaagttgccaaggggcagagatgtaaacagttcctggtttagttaaaatattttaatttttatttttttaagcctggcctttgggtgaaggagtaaaattaggcactggggtctgggtagggggaggatactcatgggcgagtatgcaaccctagggccacagcaaccaaactgtaggggaagaggcggggcgagaggggacgaagtagagacagcaagagactcacttttgaaaggcactttcggttagaaagcattctcacatgcttatctcatcgcacacagtatcctttctgctggtctccagcatctacagacgttaaaggcccaagaggagggccaccttcacacgagattccgaggagggcctcgctacccgccagttcccgcgcctcggcagtccgccgcgagcgtacgtcactcgcccgccgccaatcggcgcccggcaggtcacctctcctcccagggcccgccgccccgcccgccgcccaggccgaggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacaggtaatcctcccccatcagccagtccccatccttgcacgttcgccaagcgggggaaggaggcgtaaaaatcctagggccaaggggcgggacggagctcggcgcctggcacgtgatccccgcgcgcagaggaaggtgggcgcgcgccgacgcagctgcctggggaacgcctgtgaggcagtctccgggtgcttgatgccccagggtcttttgtcctcggagttgtctccggtgtcattccgtggcaagataccaggtttttgcagagaaggtgctgagttgggaacaggccagtctctttcatctcctgtcctgctcatcgctctctgtagcgtacttgtttattttaaagcgggctaagtcgtcgttatctaaggcctcatgtaacaggcagccccagctaccggctgggttgtaccctcagcatgtgggtgggagtgtgtgggagagaaatatagacttacacgtaacacgtatatgaccgttttatttagtaacgaaattaggagataacctccattccctcaggttagaattgacctatcataggtggcatttgaggtcatctccgtttctacggtcccggggcccgctgcggtaacttaagttggaagaaagataccttacccaagaaagtattcgaaggccggtatgaggagtgaaatcttagaaaatgaaatttagtgaatatatgtaacgttctatacttaaggaccctcacttaacccacacaactcatgaggatttcacatctaaaggatgaaaatctccagaatgcagtcaacacttgggagattgtgttgagttatgagcatttcattgtaagggggatatttctaaacggaactcagaccgagtaggatggtgaaggaatcagcaagtattgaactcctatgtcctaggttatcagggagtgcaaacatgaattaagataattctgaggtaaatagggttgcttcgccgggaacgttctaaagatctgtagtacctgacctaaaatacagcaatcgcacagctgtctggtagaagaaaaataagatttgtgtagactaaaatatagaactgataacaaattaaccaaattagtgaaggttattgggaggtgaatttcagtctaaggaagatttttttttaaattaaagaatgctttccccaaacaaatgtggtgcttcagtgatagcccctctcaaagatgaaaaaaacaaacaaaaagactctggtggtgggtggtcgatagatttagaagggataaactagatgacaaattctcttccaaatctagagattcattgaattatggtcagacagacgctctgttgagtggattgtgagattttaatattttttaaatattaagagttttagtagaaaacatgcaattgaatagaaagcatggtaacaataataaacattaaaaaggaacattaaacatcagaagcaatgcaaaagtaaaataaaatgaaaaacgtttcacatcaagtgtttataaacatcagatcttttgatcctaccagtttactctgacagaattgcagcaattccataaaattttggctttccccacttcttttacttaagtactttacatattttaatataatcctcattttttccctaacaactaaatacttattttagttttaacatcacaatgggcctaaccattcattcccttacaactggaaattagaaatgtttctattttttaaaattcattatgtaatagttcattggcaagtaagcaaataccagttgtcatatttctcccttttggatgtcttcacttaaatagcaataccaggccaaaacggtatgatcatattgtgacttttgtacccttttgtcattttgacatttgtaccttcttactaatttgcataagttaactgttgaggaatttttaacagtcaagaaaggaaaatgtccaatgaattacctatgttttttccagatggtggctgcatttgtattagtttcgattctctgtaaatcaagtataattgaagaaaattagaaagtatgaaactagatttaatggctagattttagaagtatgctttcttttcttgaggatccctagtgtcaacaaatatttaattcctattaaagacattaagaaaactcaaccaaaaccttttctctcttaagaatatatagtaacttcctcttaaaagttgttaaatatttaatatgaagactgattctcagaaataatgaccattctgagaagtattttaataacatacatttaacttaagtcccattacagtgtggctatagttaatagttctcattttattgctggtttatttaggaaacatgaacatgcttgtaataactggtttatgaaaaacatgagatagccctttttggattggacaaaacaattgcagggtttattttggagtactatagaagaaaaatttcagtggctattttccactctcggtctcccattctgaatagattgtaacagttaatgacatttggctttcttaaatgagttacttgtagaatccataatgtacacttttgttaaaataaaaacctggaagacaactttttagcaattgtttaaaatgtctaggagaccaaaaaatatttccattttcttctatgaaaattagagcaaaaaacaatacagttcacattattattgcctacatttccttccctatttaaatctagctgttttttaaagctattgactctcttatgatgactctgcattcttagaaaccacatggagatctttaatgaccatatactaaatacaggcagttctcacctatcagaaacaacttaactatctttgtttatgtcacattttcaagagtgaggcgttcaagataaattactgtgattatctaatttatgtttaacttaggtttttgttttgttttgttttttgagagggagtctcttttgcccacactggagtgcagtgtcggctcactgcaacctctgcctcctgggttcaagcgatgcttatgcctcagcctcctaagtagccgggactacaggcatgtgccaccatgcctggctaattttttgtatttttagtagagacggagtttcaccatgttggccagtctggtcttgaactcctgacctcaggtaatccgtctgcctcggccgcccaaagtgctgggattacaggtgtgagccactgcgcccagccctaccttaggttttaagtggtaatagtaaactcatgcaatgaaaatattttatcttttctacagttaagaaatagaaataatttctgtgtttagctacatatgataaatgagaaaatatgttataaaataaccagcaaccaagctgccagtattatttttatggtatcataagatgatatggctatattatatgtagatgtttgaaaatttgaaatggaaaaattctgttctagttctgtggaatgtaattcctcattaagatcggagtttgtctatgtcatttttatgtcattttatgtcatttttagctattattaaaaaatgttttaataatagtatttatatgtcataaggaataggtgtcatagctagcctgtgtcactatatataataaaaggttaaacctaattttgtttcccaaagaagatacttcattttgacaatgtctaaactttcagaaaatttatgctaaaattggtagctaccgtattattccgttttcatactgctataaagaactacgcaagactgggtaatttataaaggaaagaggtttaatccactcacagttcagcatggctggggaggccttaggaaacgtacaatcatggcggaaggcgaaggggaaacaaggcaccttcttcacatcatggcaggaagaagtgccgagcaaaggaggaagagccccttataaaaccatcagatatcatgagaactcactcactatcaccagaacagcatgggggataccacacccataatccaattacctccacctggtctttcccttggcacgagattatggggattataattcaagatgagatttcagtggggacacaaagcctgaccaaatcagctattcaagttgctttgaaattttcttttctgactagattttggttttcttttgtgagaaagggtttcactctgttgcccaggctggagtgcaggtggcatgatctctacccactcattgcagccttgacttcacaagctcaagccatcttcccacctcaacctcttgagtagctggtactacaggtgcacgctaccacacctggctcatttttttgtatcttattttagagacggggttttgccatgttgcccaggctggtcttgagctcctgagcttaagctatccactcacctcagcctcccaaagtgctgaaattataggtgtgagccactgtgagtggcctagattttgtttctctgatggtgctggttctttcattcttcctttttggtcctgttatttatcttaatagtgggatacgtggaaggctgaggcaagagaattgcttgagtcgtggcactacattccagcctaggcagcagagcgaaaccgtctcaaaaaaaaaaaaaaaaaaaagggatgtaaaagtcaatatgaatattaggtccttgctcagtattgagctcaataagaagatgaacaactcacatttaaaaattggcaaaacaggccaggtacggtgtggctcatgcctttaatcccaccgctttggaaggctgaggcaggcagatcacttgaggttgggagtacgaaactagcctggccaacatggtgaaaccccgtctctactaaaaatgcaaaaattagccgggtgtggtagtgcacacttgtattctcagctactcaggaggccaaggcaggagaatcgcttgaacccaggaggcagaggtcacagtaagctgagatcgtgccactgcactccagcctgggcaacagagtaagactctgtcttcaaaaaaaaaaaaaaaattggcaaaacagaaaaatgaacaaaatcttatcctttgcagcaatatggatgcagctggagaccattatcctaaggagattaacacagaaacagaaaaccaaataacacatattcttacaactgggagctaaacattgtgtattcatggacatgaagatggcaacagtagacactgggaactgctaaaggggagggaggcaggaggtcaagggttgaagactattgggtactatcctcactacctaggtgggaggatcagccatatcccaaacctcagcatcacacaatatacccatatgacaaacctgcacatttacctcctcaacctaaaataaaagtcgaaattatattaaaatattttaaaaaggaaatttgggcacacacaaagggagaacaccatgtgaagatggaggcagagattggggtgatagacctacaagctaagggacaccacagcttctccctcagatcctccagaaagaatcaaccatgctgacaccttgattttggacttctcgccactagaactgtgagtgaatacgtttctgttgttttaagctaaaaaagaaaacgaaaatgcaagcacgaacacattgttctctgcagtttagggaatcctagtagagactactgctcacatttgttctctcttctctgctttaatggccactaccttagttttatctcaaactattttcttccagaccatttccatggattttcaacaggttgtcttgccttgtcttcttccactagccctctctgctattcctgtggccctctaatccatcttccatctgataccagagtgacttcataggtgaacaatttcctagttaggctaatattcaaatatttcagtggtttcctattatgcacaggttagattcttacttacctgttgaatatcagagtttgtcatcatacggcacctgctcagttctacagctccctttcattaaattctaacaatactatggtgcttagtttcccagacacttaatgcatgtcatatctccgtacctttgcctatgcagcttcctctgcatggaatgaagctcctcctcccatattcccatgaacttctgtactcttcatctttcagaaacctatttaagtatcaaaacctgtacagtttttgctcatgccagtaaaaagtgaataacttgtacctctgcgttgcttctgtattattgctgatagtacacagtattatgatcgtcttttataggtctgtcttccatactaaatggcaagctcctttctaacagggagtgtgttttataatttttgtatcttcagtacctgtcccaccacctgatacatgtgagtgaggtattacaattttagaaggtgctgaaagtttttttcttaaatattttaagtagtcttcctgtattttaacttacactgtcattattcataagccatgaacaaagacaagtaagtacagaccttgtaggaattatctcaaatgccagtttattggagtacaaactcaattaggctaaaacttactgaggtcttggtttatgtaagtctctgttaaagggtagggagttagggattttttgtttagttggggaggagacaaatatttacctaactgtatagttttaaggcagaatgcattaatagtttgaattgtgttctgtagtttttactgagtgggttcctacttcattcgtttctcccagcaatcctatgaagttagaagactctttacttttctttgtgccttgaaaattctgcgctcaagtgcttgagctcctggcttctcattcgttaggtctctgcttaaaggttcttttttcagaaaccttccctgaccccttacctaaaattgcagccaccctactgctttgccccaggttagtttttctcttatgtcatcctttatttcctttataacagttactatagtctgtgatcatcttgtttatttgttcacttgtttatagtctctgtcctctgaaatatataccctatgagagaagggaccttatctattagcctgtatccccacatagtgcaatttgtggagtgtggtaggtactaagtaaatattgttgaacaaatgagcttacagttgttattcctgctttacagacaaaagaaacctggttccaagtatatgaaaatctggatttataccacagataaactgaattagttgtttactgaagtcctgttatgtgcaaattactaagcactggttacatagatataaataagacagctactgtatttgcatttagcacagtatctctacatagtaggtgtattagtctgttttcacactgctataaaggtaactactcaagaggccaggtgctgtggctcatgcctgtaatcccagtactttgagaggccaaggtgggcagatcatgaggtcaggagatcgagaccatcctggtcaacatggtgaaaccccatctgtactaaaaatacaaaaaaattagctgggtttggtgatgcacacctgtaatcccagctactcaggaggctgaggcaggagaatcacttgaacccctgaggtggagattgcagtgagccaagatcatgccactgcactccagcgtggtgacagagtaagactccatctggaaaaaaaaaaaagataatacccaagaatgggtaatttataaaggaaagaggtttagttgactcacagttctgcatggctaggtaggccttaggaaacttacggtcatggtagaagggagcgcagacaccttcttcacaaggaggctggagagagaagagtgaggagtgaaagggcaagagccccttataaaaccagatctcatgcgaacagcatggggaaaaccactcccatgatccaatcacctcccaccagtttcctccctcaacatgtggaaattatggggattataagaggtgagatttgggtggggacacagagccaagccatattattccacccctggctcctcccaaatttcacattcattttgcatttcaaaatcaatcatgccttcccaacagtcctccagagtcttaattcatttcatcattaactcaaaagtccacagtacagagtctcatctgaaacaaggcaagtcccttccacctatgagccagtaaaataaaacataagttagttccttttaagatacaatggcagtacaggcactgggtaaatacacctattccaaatgggcaaaattggccaaaacagaagggccacagggcccatgcaagtctgaaatccagtggggcagtcattaaatcataaagctccaaaatgttctccttgaccccatgtcacatctggagaacactgatgccaggggtaggctcccatggccttgggcagctccttcaagggctggcatcgagtgcctgcggcttttccagatgcatggtgcaagctgttgttagatataccattctggggtctggagcaggtagccgccttctcatggctctgccaggcagtgacacagtggggactctgtgtgagggctccaaccccacatttcccctttgcactgccctagcagaggttctccatgaaggctccacccctgcagtagacttctgcctggacatccaggtgtttccatacatcctttgaaatctagggtgaagttcccaaacctcaattctagacttctatgcacccacaggcccaacaccacatggaagccaccaaggcttgtggcttgctccctctgaagcagtggctcaagctgtatgttggccccttttagccatggctgggacacagggcatcaagtcccaatactgcacaaagcagcaaagccctgggcctggcccacaaaaccattttttccttctaggcctctgggcctgtgatggaagggcctgctgtgaagacctctgacatgtcctggagacattttccccattgtcttggcaattaatatttggctccttgttacttatgcaaatttctgcagccagcttgaatttctccccagaaaatgggtttttcttttttttgggggggcggggggaaggagggggacagagtctcacactgtcacccaagctggagtgcagtgacacaatctcagcttgctgcaacctccgcctcctgggttcaagtgattctcctgcctcagcctcccgagtagaactacaggtgtgcaccaccatgcccagctaattttgtatttttagtagagacggggtttcaccatgttggccaggacggtctcgatgtcttgacctcatgatccgcctgcctcagcctcccaaagtgctaggattacaggcatgagccaccagcacccagctgggtttttcttttctgttgcatcatcagactgcaaattttccaaacttttatgctctgcttcccttttaaacctaagttccgatttcaggtcatctctctctcaagtttcatcagtctcttgggcaggggcaaaatgccaccagtctgtttgctaaagcatagcaagagtgacctttgctccatttcccagtaagttcctcatctccagctgagaccacgtcagcctggatgttattgtccatatcactgtcagcattttggtcaaaaccattcaataagtctctaggaagttccagactttcccacatcttactgtcttctgagccctccaaagtgttccaacctctgccagttacccagttccaaaattgcttccacattttcaggtatctttatagcagtacccaactctctgttgtagcaatttactgtattagctttcacactgctataaaagaaataaaaacataaaataaaaatactaccccaaactgggtaatttataaaagaaataagtttaattgactcacagttacgcatgactagggaggcctcaggaaacttacaattatggtggaaggggcacctttttcacgaggcaggagaaaagagtgaagagcaaagcaggaagagcccattttaaaaccagatctcatgagaactcactatcaggagaacagcatgggggagattgccttgatgatttaatcaccaaccaccaggttcctcccttgacgtggggattatgggattacaatttgagatgagatttggatggggacacagagccaaaccatattagtagatacttaataattatatagtaaatatttaatttttatagtaataattatatagtaaaaatttgtttaacaatgagaaattgatttattctttcagaaaatgtttagtaagcacttaataaaaatcagaagggggggattgattgggaaagtactacaagagcaaactttctggggcaatggaaatgtattttgtcttaggtggtgtttataggtccatatagttacaaaactcatcaaactgagcgcttcacaaacacaaagcttggccaggtgcggtggctaatgcctgtaatctcagcactttgggaggctgaggcaggcagatgggagtttgagaccagcctggccaacatggtgaaaccccatctctactaaaaatataaaaattagcagggcgttttggcaggcacctgtaatcctagtgactcagaaggctgaggcaggagaatcgcttgaacccgggaggcagaggttgcagtgagccaagatcatgccactgcactccagcttgggcgacagagcgagactccatctcaaaaacaaacaaacaaaaagcacaaagctcaataaactgaactgtaaattaaacacttcaaacaaaagtaagttaaataaattgagccagacgttatatagacactggggacacagatgatcagacaaataaggtccctgcccttgtatctctctttttcttttattttttattttttttatttttttgagatagagtctcttctctgtctcccaggctggagtgcagtggtgagatcttacctcactgccacctccacttccgggatttaagtgattctcctgcctcagcctcctgagtagctgggattacaggcgtgtgccaccatgcccagctaattttctgtatttttagtagagttgggatttcaccatgttggccaggctggtcacgaactcctgacctcaagtgatctgcccacctcagcctcccttagtgctggaattacaggcgtaagccaccacgcccagcccccttgtatctcttatattgtgagtggggaacatgataggtagatgcagccattaaaatttatgtttccaactgatattaaggagttggggaaataatataataatctgacataccattaagtgaaaaatgcaatatagccttattttttaagcatttacagcctatgtatttacataccaaaaaagagatacatttaccaaataaatacataaatgttattttttataatcctaagacaaaaataaataatatgctgaataaaatacattattttatacaaaaatttgcttggtgtggtggcgcacgtccataatcccagctatttgggtggcggaggcacaagaatcacttgaacctgggaggcagaggttgcagtgagccaagatcatgccactgcactccagcctgggtgacagagtgagactatctcattaaaaaaaaaaaatattttaaattattttatttggtcaggcacggtggctcacgcctgtaatcccagcactttgagaggccaaggtgggtggatcacctgaggtcaggagcttgagaccaacctgaccaacacggtgaaaccccatctctactaaaatacaaaaattagctgggtgtggtggcgtgcgcctataatcccagctactcgggaggtcactgaggcacgagaatcgcttgaacccgggcagtggagattgcagtgagctaacacgacacacactccagcctgggaaacagagcgagacgctgtctcaaaaaaaaaaaaaaaaatttttttttgcacattatttacagttagtaatattttcctttcaaagtatctaaaatatctgtaatagctgaacatatatcaaacagatctatagagactagcacatgtaaaattttttttaagtttcttgtttgattcttctgtatttcatctttcttcatataaaatcagccttaattgacagagaaatattctatgtactcattcatatgtgggaactaaaaaagttgatctcatggagatagtcaaatggtagttaccagaggccaggaagggtagggagggagagaatgaagagaggttggttaatgggcactatagtacggttatatagaaaaagttctagtattcaatagcataatagggtgactattgttatcagtaattttagtgtatatttcaaaataggagaggaaatttggaatgttctcaatataaataaatgataaatgaggtgacgaatatcccagttacactgagttgatcattgcacatcatatgcatgtatgcatgtagcaaaatatcacttgtaccccataaatatgtacagttattatgtatcagtacaaaaacagcctgaataaatgtacttacagtcatttgaattgagcttttcaagctgtattgctttcatgtataaagtttttcagtagttaaactgtagttggttatctttaaaaagtagattatgttaagactttggtaagttattactttgttgtaggaggtaatagtacctctcatcactgtatttttaagcatagtgttttaccaaggaattaagtgttcaaaagaatattttctgaagtggattttaaaacagtagtaataccatttgttcttgaggtttgtgggttaagataggaaatgctatatttaagagtctaacattaaggttttcaaccaggcatggtggctcacacctgtaatcccaggactttgtggggctgaggcaggcggatcacttgaggtcaggagtttgagaccagcctggccaacatggtgaaaccccatctctactaaaaatacaaaaattagccagacgttgtggtgtgctcctgcagttttagttacttgggaggctgaggcaggaggatagcttgtgcccgggaggtggaggtggtagtgaccaagagcacaccactgcactccagcctgggcaatggaagtgaaaccctgtctcaaaaataaataaataagattttcatctttgcgttcccattcactcgctttttgataaatttaagctcttatgacttctaaaatattgtaatatgtacaataatacttaatgttattctacattgaacaaacatttaatgactgctatttcgagttacatactggatgctggggccaattgcaagctaagataattagtcagataaaacagaaggaactccatatgcaaagaactcaaaaaggctgcttactagacagtagctttcgctggcctcaggtacatgaagagaccatgtttgtggaagttgaagctggaaaggtagccttgccattctttggagatggcaccttatagagccaatgatctatagtagcattgtccagtaaaactttgtggtaatggaaatgttctctgtactgttcaatatggtagtcagtagtcacatgtagctagctattgagcctctgaaaggttaccagtgtgtcttagaaacagcattttacattttacttaattttaatttatttacatgtgaatagccacatgtgtttgttttgttttgttttgtttttgagacagagtcttgctcttgtcacccaggctggagtgcaatggcatgatctcggctcactgcaacccctgcctcctgaattcaagcgattctcctgcctcagcctcccaggtagctggaattacaggcgcctgccaccacgcctggataattttttgtatttttattagagacggggtttcgccatgttggccaggctggtcttgaactcctaacctcgtgatctgccctcctcagcctcccaaagtgttgggattataggcatgagccaccacgcccacatgtgtatattaaccgtgttttcaattttctgtattttattatgctttaatatcttaggagccttgttggctgtggagacaatttaattcctagagatactaaataacttgcctgtgagcatgcctttcatatgcaaaccaaccaatccaaagcccatgcccccaaccacctcctttatctaacccttacacatgaagtcagtatttctccagtcaatatttctcctgccctaagtcaccccagggacaggtaggagacgactagggaccactacttttgcccagaacccactgaaattattcaagctagccagtcctgaacagtttcctgccttgccttttccatggaaaccacagtaaaggcctgtgcccatgctttttccctttcctctttcttcctcctgatcaaccctagtacctctcatgtggccctgcattgcatagtgtatcctctcctcttgggaactataagtaataaactgttatttcaagacagtttctacaagtctgttgggtacaaatctaaacagtatggctagtggtgcccatattgaatagcacagatcttatacctaggcctccttctccccgcaaaaacagttctgtgttatctccagagctttaattcactcaaagaacctatttggagtgtctccactttggttatgagaatgtaacagccagcatggcagacaaagttcatacttttacagagttttattctggtaactacaagattatattcctgaagatttttgcccatatagcattgtcaagttatttggcaaaatatttttttcaaaggagttgctagtacttcctcaccaatctctataatctctgaataaaagctaccatttattgtgtcttttttgccagccactcttataggtgctatctatgaaaatggtagataaataggttttttcatttagatttctttggcatgatgttatatcaaaaataattccattttggaagagttcatattgtctttctttcaatagttaaatagtactattatctcctgagagtagttttaccaagataggcacagattttaattttagatctattgggtttgattcatgataactgacaacaggctttggatttagggtgtcctggactaaacctgcttaggctacagttttctcacatgtaaaatggggataataatgatacctaccacatatagttgtttaagctaacatagtgttaaatgagctagtgcccttatacccttagcataacctgttcatttatctttaatgtttattagcatgagttagcatattattttctgtttttctcttttctcaactaagctatttccacatagtgcctagcaaggtatcagattcggcattcagtgaaggaagttaactggtaattctataagaacagaaaagagcccagcagaggcagggtgctagcagacatttgataaatgtatgttgaaatgtttatcttggtttcctggtatttttgtgtccacatgcatagggactgtttcatttgtatcacttatattccctgtccccttaagacaggctaggtactccaaaaggctttaaatgaagtttatggaattagatgtatcttaaaatgagaacattcaacatagaaggtttcaatttgttctttaaaatagtagcttttacacaaaatttcagtgttctttagcaacatttaccaaaaatgtaccttaaagcatcagaggacatgttctctctgatattatgaatcagtggtaaaaattctgcagatattctgttgtatgattttgacatagtattaaggagataaaatgttttcttaacttataaaatatacattgaattttgtttatagttatagtgatcataactcctaaaataaaaatagacaaacacaaatagacttgatgtagacaatgagataggatatttgaaatggaacctatttctgaaaagttaggtttctagtttcactggtctcaaattataaataaagtaaggtggtctttggtagagctggctttattgtgttatttattcacagttttatggatccattaaaaaggaattaatgtaaaaagtaacaaagaataagctcaaggatgaaacgacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacggtaagatgtctgtttacgtgtacactaaaattttgcagtgctaggattgtttcgcctcttaaatccccagttttgaagttctttaagatgagagaattttctgtaatatttggtattgaaagaccatattcctaaattgaagttttcatgtcatgatagatactacctacattagaaaagttggagcagcaaagaagaataaaaatctaatgccttcgcaatgtttggcatttatgtagagtaacatgtattttaaaatacacattctttgagagaggacctaaggtttaatggaaaaaagctttggtgtcatagtaaatagtggtcaaatatacttgtcacagtatgagtttggttggacaagttacttaatttttaatctctaatcttcagggtttgttttaacctgatacatccacattacatatctttgagaagtgagatgatatatgtaaactgctttaataatatgaggtagtaaatgatagcctcaattatagatgatttttaatgtgggaaggagtttggagtgataagtactataagtagttgacaaaatctgtttcttgtacttgatcatagattatttgaggtttttaatacagtattgctcatcacagcatcctttgtaatagcaaaatttttataaactaaatatctgataaaaagggaatgatcatgtttttaaaggatatataatgacatgagatcctgatatgagtaagaaagcatattacagtgtgatcccaattttgtttaaaaaacgaatacacgcaggccaggcgcggtggctcacgcctgtaatcccagcactttgggaggccgaggcaggtggatcaccaggtcaggggttcaagaacagcctgaccaacatggtgaaaccccgtctctactaaaaaatacaaaaaaaattagccaggcgtggtggcatgcacctgtagtcccagctactcaggaggctgaggcaggaaaatcacttgaacccaggaggcagaggttgcagtgagccaagatcacgccactgcactccagcctgggcgacaaggtgagactgtctcacaaaaaaaagaaaaaaaagaatacacacaataaatgcataggaaaaaatataccaaactgttaattattattacgtgtatctggatgggttatgagtgaattttttaaaatttatttttatttattctttatttatttttgcgggggacagagtcttgctctgtcactcaggctgaagtgtgatggcatgatctcagctcactgcaacctccacctcctgggttcaaggaattctcccacctcagcctcccaagtacccgagacacaggcgtatgccaccacgcccagctaacttttgtatttttagttagagatggcgttttaccatgttggccagactagtcttgaactcctgatgtcaagtgatttgtctacctctgcctctgaaagtgttgggattacaggcgtaaactaccgcaccagcctaaaatatatttttgttttcaaaaattgtgtggtatgcatgagttttatagcaagaaaaaattataatttattttgaattaaattccattgttttaaaattaagcaataggtgagctcgaattttaagctccacaaatgaccaagaacttattcgattcccttttaaacctgttgtctattttaatcactcatatggactcattcataggtttttatttaaaatctaaaccaaataatgaagtaactgtttaaattgttagattttgaatatggttcagttggatgtagaatgtaactattactcaggaaaacgatctgattttttttagcaagtgatatgctttctttctgagagcatttcacaaatgtttctacctaatgaatcatattttaaaaataacacttgtaattcttttttctttttagtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtattttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacatagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctcacttctttgactctgggtgctttttcggatacattttcttcaacactgttaaggggcctcactgtcagattaaccaattatttttccacagttggtcaccagactttggaaaaaatccacctcaccaaaattttggatatcctgatctgtgttcatgaaatgctcttctttttgtaaaatctatcactgcatctcacagcaacttgttttcacacatgttctagtggttcccataacttagattttacaggaggcaaatttactaaaaatgaggagactaaaatgaatgaccaactttgaattttgtcaaataacattgaaaatgaattatctcataaaaggtaattttaataccccaaaagtaagatggttgtactctcagaataaagacttttccctgccacattttcagttgttaaaatatgctaagagctatgcccatatcttttcccacctgtgcacatttttcagaagcgtagggttggtagtaagctgttgctttaataactcctttaaataagcattattagcagtttgcattacttcttgtaaatttacacaattttatcttgtccatctttaaaaaatagacatctaataaccaaatgtatttgaattgatgcagtgtaagtaacttgtagaacttgaggataagtggtaaaagaaaaaaaaaagtaacttggctcttgaaatacatgtcttcggtttctagagccttcaaaatacagccctgttgttactgcgtcacattatgattgttttgaggactgcttctgcttacctaggaaactactcatgccttactcagcaaatgaacatcactattacataaacatcaggtatccaaaagtgttagcaggcttgaggtatgaatgattcattcatatgggtaattaagcaagttgaattatggaaagcacctcacaattcacacaattcagctttgagttcaatgccaaatacgatgattcattaagttgcctttgtattttgtaacctaatttgttaataagtaagttacaggaagccaattaagccagctgctgatctatatagtactaccttcctcattgtgattccatagtcttccaatagaaatgtgctgtcagaatctgtatagagagtttgtaaatgccactatttaacaaggttcttaagaatttaggtggatgttttatttgatacctaccaaagaagcctaagtaattgtataatacttaacccatttagaattcagttgtggcagcataaccaatctggagagaccaggggagatgttactaatgcttgtactttattcagaagtgagtgcctcattggcttggtgcagtgacgacacacctgtaatctcagcactttgggaggctgaggtgggtggagtacttgatctcaggagtaccataccagcttgggcaacgtggtgagatctcatctctacagaaaaatgcaaaaattagccgggcacagtggcgcaccagtagtcccagttactcgggaggctgaggcacaagaatctcttgagttgaggaggccaaggttgcagtgagccaagattgtgccactgcactccagcctgggcaacagaagtgaaaccctatcttaaaaaaaaaaaaaaaaaaaaaaaaagtcttttttttttttcatctaatcaaatttattgtggcagaaatcagtacgaagttcgtaggacaggaggaaaccaatataaatatctcagcattgtaggaaatttaacccatggaaagcaggggtgaattaaagaccactttgaaggctgggaaaagcagataatttagatatagtcaaagtatgaaatcattgatagatccagaacaaggaaatgatgtatgtgtttacatattacatctactttattaacaattttccctctgttaaactaatatcgactaatagtagtctaggtaagtcaagttcaaattaagtggtaattgaaaaagtcttctttttaaaaaatttttaatggtagaggcagcagctacccagagtctacttattcttacttcacattgaattctaacaagtttggttatctgatttctgcttcttaacaaatcacaagtatcaaaagggtcttgcagaaggggtgaactacagaatgtgacagctgacagcaagtcaggggaacaaaaataaatttaaggtgaacattaaaggcatagcagcttgagacaatttataggattctgcatacaactgtctctgaggacatcactgtgatcaaattatacaagtgatgtttagtgatgaattggaatcaagataagtagtatgtgttattcaaaaaggcaggatatgtgttgcatttggtggtaacaatttccccttagctatttagttaaaagcttagtgcttaacatgttggaaaatttatatgtaaaatatattgacttactcgatgattggaggctttatcacaggaagttttcccattcaattgaaacatttttcaagcttaatgactataatttactacataattatttattttgttaaagtttgaggaaaactaaataaagcagtagcaatttaagtcataataaattttgttagatgacttcttccactttagggggaattaaaaatcatgtttaaaaaccacatgtgcagcagttctgtgactccctcaacatccggttggccatatagtccctttgcaccacagaggttggagtatagaatatgcccaaagctgttttgttttgttttaactatgcttcatcatctgaggttgtgttaacatagtttgtcctaatagtcttttactggaaacttgctatatttgatcatgttcagcaagtaaactaattttatctactttcatatattttgagacaaagtctggccctgtcacccaggctggagtgcgggggcatgatcgtagctcactgcagcctcagcctcttgtgctcaagcgatcctcccacctcagcctcccaagtagctgagactacagtcatgcttcatcatgcccggctaattttttatttttctaagagacagagtctcactgtgttacccaggctggtctcgaagtcctggactcaagtgatcctccctgcctcagcactcccaaagtgctgggattgcaggcatgagcaaccatgcctggtgttttatcttttgcagaaatccaatttagtaaagtcatgttgtagcaagcatcactttaatataaaaagtgtacagcttatattattagcaattgtactgtttaattttatattagttatggtcttgaaggacattgaaaatctgttcagaaagactatgtttttcaaccagagatgacatcactctaactttcctttggtttaaatgcttgattcttcgcttacaaaacttctgttttgaacaactatggtgagaaagtatatttgtgatactgttttcttagaacactgttgtcagatagatcagccataatgttaacacatttctgatctctattataaggctgtaattttccaaaataatacagaaaaggagaaaagggtagtacatttcataattagagataaccctgtactagtgagaaaataaaaatgtcaagtttattaaattttcagatttcctgtaatttttccattactatccctcataaatttctctgcatgatcacactaaagatataaattaatcacatccattcaacaaattaagaaactcaaaactcacaagtacaatcttcaaccctatagaatgctaccaagaagtaaaataagatgaaggtagaaagattctctttgagggccaggtgcggtggctcacacctgtaattaattccagcactttgggaggccaaggcgggcagatcgcctaaggtcaggagttcaagaccagcctggccaacatcgtgaaaactcgtctctacaaaaatataaaaattagctgggcatgatggcggatgcctgtaatcccagctactcgggaggctgaggtggaagaatcgcttgaatccaggaggcagaggttgcagtgcgccaaggttgtgccattgcattccagcctgggccacagagcaagactccatctcaaaaaaaaaaaaaaaaaaaaaaaagaaaaagaaaaaagaaagattcactttgaaatgctgcatgcaactatttagcaacacattggaaaatctagagaaaatgggtaattttctggaaaaatataaatgaccaaaactaatccaagaagaaatttaaaatgttaatagaccagttacaaagaagagaatgtaaagtgattttttaaaatccataatttaaaaagtactagggttgcaagaaggataattccaatgttatttaaagtatcccaaattttttttaaaaagaaaaaccaattcatttcacataggcagtgcagcattaatatgaaaacctgataaacataagacaaaactgtaggccaggtgcagtggcttacacctgtaatcccagcactttgggaagccaaggtgggtggatcacttaaggtcaggagttcaagaccagcctggacaatatggcgaaaccccatctctactaaaaatacaaaaattagcctggcatggtggtgcatgcctgtaatcccagcttgaacccaggaggcagaggttgcagtgagccgagatcacgccactgcactccagcctgggtgacagagcaagtctccatctcaaaacaaaaaaacaaacaaaaaaaccaaaactatagaccaatctgacatacatatgaatgaatattctaaataaaaacccagcactgttatcaataattgcaacaacaaaaaagagtaatacagtatgcaaagagcactgtatttcaggaattcatgggtatttcaatatcagttaagtatattaacacaattacataaatgacatcaaagaagagaaaaatgtgattatatcaataaatgctgagagggctattgttaagattaaacatccactcctaatgaagattcttgagtaaaatagaaattgaaggaaagtgtctaaacataaccgttatttatgaaacgcctacaaaacaagtattttaaatcatgaaacaacgtttcaattaaaacaaggaaccagtaggaatagctgctgtcattatttgttattaaagattatcttggaggatccatgaatgtaacaagatttttaaatgaaataatcagtataaatatatagaaaactttttgtggatatgattatatgcctaggaaatcatagagattaggaaaaacagaaatttcaaatattttaaagaggaatattggtaagttatttggaaataagatgataatacaaaatatattagcaataagcaccttgaaatgctagtggtaaaaatattcacaataacaaaaataataaaggtaaaataaatttaccaagaaaggtagaagatctataagaaaaaaactataaaaatgttaccaaaagctactgaataagaaacacatgaggctaggcgcagtggctcatacctgtaatctcagcactttgggaggctgaggcaggaggactgcttgagcccaggagttcaaaaccagcttgggcaaattgtgaaacgctatctctaaccaaaacaaaaagctagttgggcttggcgcatgcttatagaaccaggtacttgggaggctgaggtgggaggttggggcttcagtgagctgagatcccaccactgcactccagcctgggtgacaaagtaagaccctgtctcaaaaaaacaaacaaaactcttgtaaaaacataaatctaaaattatatataaattcaattaaattcacattagaatcacaaaagcattttaaaattggattaaattatcttaaagttcatgtagaagaatagtcagaaaattgttccaaaaaaaagactattgagaggaacttttctcagcagatatcagcacctactatagaactattggaattgatcaattaagaaaaacaattgtattaagaataagcaagagtggtaaaaaattgagaatctacatgtagatgaaaaattaatatatgaaaataaacaattcaaagaaaacaaaattggaccctcaatttacactgaaggctttgaagtgacacataaaatgattttttaaatgatttaaatacgtacataaatggagacaggaagggtgggagagaagcagaagagaaagaaaatagaagactaaagaacaggaacacctatgtggaaaaaggtaacacttaatgacaaaatatgttttatgtgaatatcagttatacataataaatattggggacattgccttgtgggttataataaagcattaagaaacagagtagtgaacaaaaaaaggaaagaaaactaccaaattccatgtatgataccccattttaaaattacataaattaaatgtgtacacataagaaaattttaaacattaaaattttgttaataaaacagatttgataacacgaaggccaatgatgaccttacccacagcagttttgtttaaatggggactaaggatggagcaaaatttttagtagagcactttgaataatgaattagcaaactataataaactgaaatcttacctaccaaataatctcagtaaacaaatctaaaagaaatgagtaaaacaattgtgagcaaaaaaggatagagtcactacatataatgtaaatgagacaaggatggcctctgtgtattggtgcctaggttatttcttcacagcaagctgagacccattagctcaaaagccaactggcagcaaactcaaatttttaaacatccaattgtgttaaacattgcccagacatgcagatttgtaggcatttagagcctgcctgatttacatgccctgggaaactgtgtccaaaatctgcctgccacagataaaccctaggctgtaaagaccccaggctgcttctgctctttggaactctgtgaactatagactccatgccatgctgctgagtgatatcactgagacatgaaagcctcctctctgatcctttcctccctcaggagttcctttgccctcctccccttctgagtggtggcccccttgcctcaatcctctggtccatctcttgctgtgaaggccttccccaggatacaaacctgacgagatcatccagataaagcccatgtgtgcttctgtcacatctttttctatatttttctcacttttttctaaacttttctaattttttcttaatttttataaaattgtggatacctaataatgtagtctcaaaataaataaagccaaaattagaactggaaagagcaataaaaaaatccacaaacatagtgagagattttaacaattcatttttagtaattgaaaaaataaacactgcacaaacttcccgaggctccaccccgtaatcccagtgcacaggtgggcattattcagaatcagtggggaaagggcggcttcaaccaggacccgcagtccagtttatctaacagccttcaggctgttttagtcttgaaggtggggttttaccgggggacccttggttgcctcctgtctctatcactttcacattaggtgctttgtggtgaaaatggtttcaagggtgatggcattgtacatattgagacacagaagcagctgaaagttctattaaaaaatgaaatggatgcttctaaatgacagcaaagtctttgttggattaagtcttgtaaacaatgagaagcagaactcagagttaaaaagttcaccaatgtttacaggaagatttttggagaagacatggatggtaggtgccttaaagatctctttggcaagttgggatctgtcttaagtgtgaaagtagtggttaatgaaagtggaaaacccaaaggttttggatttgtcagctttgaaaggcataaagatgcgcagatgagatgaacagaaagaagctcaatggaaaacaaattgatgttggtcaagctcagaaagaagtagaatggcagatggaacttgtgtgcaaatttgaaaagatcaagcagtataggatcaccagataacaaagtgttaacatttatgcaaaaaatcttgatggtattgatgaatgtctctggaaagaactttctccacttggtacaatcactaatgcaaaggttatgaaggatggttgtcacaacaaagggtttgatttgtgtatgtttctcctctccagaggaagcaactaaagcactttcagaaatgaatggtagaattgtgggcactgagccattgtatatagcattaactccatgggaagaagagcaatgaagagcaccaggctcagctcattaaccagtacagtatgtgcaaagaatggcaagtgtaaaaactatgctcaacctgggaatcagcctctatcagccagcaccttcttcaatttacttcatggtagttatcccacagactgacagccatgctgcaaagtattctcctagccaaactgctcaactaagatcaaatcctccctaaattgctcagggtgccagacctcatccattgaaaaatatgcccaagccactcctagctcactacatttagtagtaagagaccagcttcttcacagcttccacgagtcatgtcaacacagctgttgtaacacatcaacacagacaataggagcacattctgcagttgccgctactgctactacagatactcctgctgtttgcaccatttcacagtataaatatgctatggaagttcacaatcctcaatggcagtttcatgcacagccccaagttaccgtgcagcagcctgctgttcatgtagaaggtcaagaacctttgacttccatgatggcatctgctcctcctcaaaagcaaaagcaaacgagtgaatggctctttcctcttcttcaagccatgccctagtcgtgctggtaaaatcattggcatgttgttggagattggttatttagaacttcttcatatgcttgaatctccagagcctcgctgtactaaggttgacaaaggtatagctgtaccacaagaccaccaagctaaagaggctgcccagaaagcagttaatggtgccactggtgttccaattatttaaaactgatcagggaccacagaaagaaacttgcgcatcactgaagaaaaaatctcaatatcaaaaaccttaaatactatggaaaaaatttgtaaagtataaaataaatttaaaaaggaaactttgaactttacataccaagcaaacgtcagatctaacaaatgcaatgatagtcctagattacttactgatttgaaaacaaaaaatcctcccaaaataataaaatataaaaatgctgcaatgcttttcagactctgtgataaataattttcagcaaagtataaaaatttaaagcattcctttaattttgtaattcgttagtgtggaatagctcagaatgtcacttctgttttaagtaacagaattgataactgagcaaggaaaggtaatttggattataaaattttgctttaataaaaattccttaaacagtgaaaaaaataggcaaagatacaaaaagttgataagaaacaacaatcttgtatttatttgttattttatttttttgagacggagtctcgctctgtcacccaggccggagtgcagtggcgtgatcttggctcactgcaacctttgcctcccaggttcaagtgattctcctgcctcagcctcccgagtagccgggactacaggcacctgccaccacgcctggctagttttttgtatttttattttttttgttatttgtatttttgtatttcaccatgttagccaggatggtctccctcccctgacctcatgatccacccgccttggcctcccaaagtgctgggatggtgtgagccactgtgcccagccttatttgtttaaatactataaacactaatatcatacacatggttaactggttgtaatttttaaattatattaataaatttttataaaaactttttataaataaaaaacttaaaatttcaaataaataacaacatctgccacaccaccttaaaagggcgactatttcagtataataaacatatatcacagacacttagagaaagttcaataaataaagaataaaaagaatagttacaacaattttcctcctaatcaataacacaattcctcattttgaaaattatttatctctcttttattaaaataaactttctactttgaaatctaatcctcttgtgaatgtaaaatactatcttgtaaatatatatatatatattttattattattattttttgagacagagtcttgctctgtctcccaggctggagtgcagtggtgcgatctcagctcactgcaacctctgcctcctgggttcaagcgattctcctgccttagccttctgagtagctgggattacaggtgtgcgccaccacacctgacaaatttttgtatttttagtagagacggggtttcaccatgttggtcaggttggtctcgaactcctgacctcgtgatctgcccatgtcggcctcccaaagtgctgggattacaggcatgagccacaacaccctgcttatatttttattttcttgtaagtgacaatgagatgccctcatgatttaaatagtagtcaaaacactggcacagtttaaatttttagaatttgagtactagaattacaatatttgaaaatggagtctgtactttgttgtaaaactataaggagaaaatgtcactaaaatagtagctattttatcttttcccagagttattctcccagagtgtattttctaagagttatttcccagaaggttttagaacttctggcagtttcggtgatatattctgtaaaagcccttagtcttaataggaataacacatagttttgattgccttaaattttaattgcttcacttggcaaatttatgtgtaaatgtcatattctgtggtattttaataccttgcttgtggagaagaggaaaaagaggaatgaaagtaatattcagtccttgcattgagcttttgccaaagaagtctaaacaatttctaagatgccattcaataaggccattttagaatcgtttatatgactcttataactttaaaataaagagtcttgaagttaattaaaactcactttgcttgtgatgggttctacattaacatggcagatttaatcagccagaattaaaaggtaattctatattactaaggagaagaaactgccacatgacagcagtctccaaatctttcatttttggaggctgccttttatgcctagattttaaaatactaattgaaaaaaatatagtttacttccatttgtgatttaattttatttctataaataaaaatatagatagtgtttcatctaaaaactgctaaaccagactttcattttaagggcatggcagaagtaaggaaagactaacttggttctattactgaacatattatttactcaggtagtcaccaaaaccagaatttaaaatctatttagttaacccatttaaagttgatgtgttttattccttttctttctttttgtggtgatctttttaactgaattactggacatcatgggagttctactccttctatttggaaacttaggctatcttaccaagttcaatattcaaagtttttctttctgccattaagtttgtttaattttatattaagctcagtttgtattatgatatcaaattcagcctgagggattactttaaactttcctagggtatttacagatttaatttgttcttacagtatgtaaataccaagagagcattccatttaatattatttttattaaattaactttggagtaaaaagtccaagaaaagccctgtactgaaatcacatgtttactaaatcctggattctctgtacagtccccacatatttctactttaaaattcttctgtcatgtgaaataattcattaaaagaagcaggcagatgatgacaggtaaactttttaatgatgttctaatgttgacaactgcagttttattttgcttggatcataatggcgtgtaagcattttaggccccagaatgcccataagtagagctccatttggagctgtgatcaagatggctaaaaatgctactgtcatcacatccttcgcatatggttccaagtggggtgcggagactcttgctgtttctagagccagaggacctaacacagcctgcatttaggggtaaaaatggggcataaagaaaaatattaaactgagttgatatataatgtaaatggctctgttaaaataaacaaaatctagtactagactattagaaaaaaaaagtactcagtaattttcataagttactcatcagttccatgttcttcctagcaaatatatgtggaggaagagtacaatagtgacaaatcagcaggcaaacatttttgggctgattttgcactcttgtcctctcagtgttcctctattcgaatatctcttttgagtgttcatgttgccctcataacaccaggagttctaacgaaaccagttttgcttagttgcctttaccgtgtgcaagtggttcttgactacaacaagacaacataaaatactaaggtttcttatggttctctaggatttgttgcccttcttctcattgttctccctattcagggggcactgtgttatagcagaactgacagcaggcttggaatctagcaaaccgggtttgaattctatttttgctgcaaccaggctagtgaccttgtacaaatgactcacactctctaaccttctacttacttatgtgtaaaatgaagaacaaaatacttatcttactgaatggttgtgaaaattaaatatgagaatgcaaagaacagctggcacacagtaggtattcagatagtagtaagtttctctctccctcactcctcatgccctgccaggtcagagaatgagttcctttgaagttttcgttttagaatgactgtactgggtcacaagtttttttccctagtcaccttctaccacattatttttaataacataaagcaaatttcttgctaaccctctttctttgtgtttaataatctaggcatgaaattgccttaaaattttggggaattaaataccaatatataacatattttctatggagttgcaaagtaacaacataatggtggaaacattacctctgatatggaacattatggcaaaagaacccctcaatttaagatcaatttctatatcctaaatcaataatttaaaatggtatcatttttatatcgtaacttttaatgtactgaacgtgagccagtgtgctggaggatgctagggagaaaaagataatcatgcagaaaaccaacttgaaagaatcttacagtttagaagaggatttgaacataaaagaacttccaacagaaaaaacaaaaaacaaaaaccaaacccattgacttttaagagatgattatgataatggtgaaactagaaataatatttatatagttatatggcattcatcatatggcaggtatcattcttaaagctttccatttatcaattcatttaattcttacgacaaccttattatgtgaggactttattagatgataaatgatttcctcctagtgactgagatttaatattatttctttaaaagaatccaattgccaagctgatcttacatttgtaaactaaattatttatttactctcctaatagcttcatttttccactctaatttttatcagtaactcgaaactgaagaacaagagaaagagctgaaccttagccaattttatgttagcagcagagaacggtggaagaggataaaggtgaaaataatttaaaattgaaatttaaatatttgttgatcttatttacttgtgacattatcgttatctattattgctgttgtgactctacttgtataaataattaattttttatgtcttgccagttcctggaaccagcttgatattctttgtgtagaagctagcctgaagccagcagacaggaataggcagaagcagaataatactgcaggactcgagtgagtggtctctttcctcatacctgcttttcttttttccctgctttatgaaaattatgaaataataaaacaaaattgcgagagtattgttggaaggagagagaacagatactccttttgtagatttattattccctacagtagacattaaaaataaaaagttattatttatattacttgaaggtaagataaaataacaacattgttaattgagcaccaccatatgccagagagagtgctaagcactttacgtggattatctcattgaatcctgacaacactgctaagaaacagatacagtcatagacttcattgtaagatgagaacactgaaggactgagagattagaaaataattttcctgaggttataggcaagtaacatggtattcaaaacaggtagtcaggccctatgaacctgcttttctaacatgataatagaggttttttttgcatgaaaatttaggagcttctgttttggaataacaactaagaaaagagccacaggaaattaaggtatattatgctgccaagttaaacagtctaacaataagtagcaatatattttaggaggaggagaatatccttgaataagagggcaaaattacaaggtttccctttctgttcattcattcttgcaggcatgcaatacacatttggctcctgcatgtcaggcactgtgttaagtgccagggagaaataatgaaaaacaactgcaacaaccagacactgtccctgtccttacgtagtctatcaagggggcaggggcagggatttagccattaaccaaatagaatacaaataaatgtgtaattaaaaacaataaatgtgcatttgtgtgatggagtgagtggcaaggtaggaaaagtattttttaaaaaatcaatgtgtctctattttactttactttttttttttttggagacagggtctcattttgtcacccaagctggagtgaagtggtgtgacctcagctcattgcagcctcaacctcctgagttcaagcaatcctcctgcctcagcccccaagtagctgtgactacaagtgcgtgccaacacacctgactaatttttttgtattttttgtagagacgaggttttaccatgttgctcaggctggtcttgaactcctgagctcaagtgatctgcctgcctcagcctcccgaagtgctaggattccaggcatgagctaccatgcctggcctgtgtctctactttttaaaatcataacatttagctttgttatattcagcaaaatataaaaactccaattttcagatatattcttattatatattttaggaaaataaaaaacattttcataaacttaggaagtacttattgaaagaatactttttaatttcaaaagaattgcttttaaaactgagatttaaaaaggttacattggctgggcccagtgggttatgctcataatcccagaactttaggaggctgaggcaggaagatcacttgaacctaagagttcaagaccagcctgggcaacatagcaagacctcttctctacaaaaaaatcagaaaaaaaagaccaggcgcagtggctcatgcctgtgatcccagcactttgggaggctgaggcgggtggatcacttgaggtcaggagtttgagactagcctggccaacgtggtgagaccccatctctactaaaaatacaaaaattagctgggtgtggtagtgtgcacctgtataatcccagctactcagaaggctgaggcaggagaatcgcttgaacctgggaggtggaggttgcagtgagccgagatcatgccactgcactccagcctgggcaacagagtgagactctgtctcaaaaaaaaaaacaataaaaaagcagttgggtgtggtggcaggtgcctgtgatcctagctactcaggaggctgatgtgagagaattgtttgcgcccaggaggttgaggctgcagtgagctgtgatcatgcgactgcactccagtctgggtgacagagtgagacctggtctcaaaatgaaaataaaaataaaaatagaaaaagattacattaaggttctttgtttttgtttatttatttatttatttatttatttttttgagatggagtcactctgtcgcccagactggaatacagtggtgccatctcagcttactgcaacctccgcctcctgggttcaagcgattctcccatctcagcctcctgagtagccaggactggttacgttaattttaatgaatagttatgatcaatcaaacatttaaaaagtaaggataatagctcatattttgtgactagagtaacatttttcattttaaattttaaaagcatcaaaatgaaagcattaagcaacaggcttaatatgttcttacctgtactgtagctttgggcatccatgctaaagcaataaatattttctccttaaaactaaaaccagcaaagcacatcaatagatatgtggttaaaattcgaacacataatgccaaacttagagtggcaacagatatgcctacaacagatgaaaacaaacataaataacaaaatatttgtgaagaagtgttcttcatgcccaggaatatgatttctaaaacttttgaaaacattttaaggctattgtctcttcatgtgcttattttttacataaaaacaatgattataaaaaatgaatatgatggaggattctctgtaaagtgcaagagagtatctgatggtggaagtaccatgaaaaataagacagatgacatttatacaattctgaactaatagacttcttttgaatacttttattattaataataataatttattttttgagaaggattcttgctctgtcacccaggctggagtgcagtggtacaatctcaactcactgcaacttccgactcccgggttcacgcgattctcctgcctcagcctcccgagtagctgggattacagacgcgcactaccacacctggctaatttttgtatttttaggagagagggggttccccatgttagccaggcaggtctcgaactcctaacttcaagaaatctgcccgcttcggcctcccaaagtaagattacagacatgagccaccacgcccagccaatagttttaaatgaaagtactcaaaaagcgctgatcgtatcaaatatgttccctcaggaaagaaatcttatatttatttcttcagataactcagggaatatattcagggctgtccttggtttataaaaaaaaaagagcacccagtgtaaaggaagagcaatatgaaaatatgacactgtatcaacatgtgtttctgaagaaggtcgttgtagccaaagatatattgtaaataaaaataaatgtatttataattttcttaaatatttttgaatttcatattttttgtgctctaattattcttaccaacaatatttgattcaagcgatgaaacagatacttctgctccaactaaaccaaaaagaagtggttgaaaaatatcccatacagtcgtaataatcttttggactttcatctatagaaaagagaaatacatttataatgattttggcacataaatatatttcagaaacttaaagtcttccccccccttttttttttcattttttaagtattttagagatggggtcttgctctgttgcccaggctggagtgtagtggcataatcatagctcactgtagccttgaactcctgggctcaagtgatcctctcgcagtctcccaagtagaactacaggtgtgtaccaccatgctgggctaatttttaaattgtttatagagatggagtcttgctatgttgcccaggatggtctagaactcctgtcctcaagtggtctctggctgtggcgtcccaaagcactggcattataggcatgagccaccatgcctggcctaaagtcatttaacatttaataaatttaagacactttattttaataaaaatgttaaacttaataaaaactgagcacttcaatagttttattcaaacacttaggtagaatttgattaaaataaactcacaaagcaataaaataatactatttggccattttgtcacagaataagtgatgtccttagggttctagccatgtttcgtatgagttccagattttgtctgtaaagtaactgaacagagatataactacatcatgcctgatgagaacatacccagttcatgcaaacatttgggttctcaaaagggggttgggaagccctccactaacaaccatcctggaactcaatcccattaaagtgaatcctgatatatatagcatatactactaggaaaaacaatttggaagtctgctaggcctgcttccaaagaacccatgttgaatattttaaagttactttttccttaaaacaaaaccaaaacatatattagattctcatttaactgcctacccagcttccctttctggaaacgaatgcctcccagtgctacttccccaattaaaacgttacaggaaaggcccctattggcctacattactctggctcttctccaggaatttggatgaagagatttcagtctcagtctgggtttaacatttttttttttaaacagaagatacataagaactttgatgtctcttccttgaggcataaactatcttcataactatttcccttatgactgtgttttctgatccccacttattatagtttaaaaaaagaaaaacaaagaaaaacaatgttactattctttacagcataattatcctatttgttacttttaatctttaaaacttgttttagttctgtttcttttaccatttaaaaaaattctagcagttttaattttatttattgatttgcatttcattcatttcatttcttttatcattatgattatataagaatactaaacaaaatgtcactatgatttttggttggggaacttctcaagctgattctaaaatttatctaagaaagaatatgtgtaggaacagccaaaaaatactttaaaaagaagtataatctatattagattttgacacataaaactgcagtgatttaaaacagtggtgttggcatagaaatagagaagtaggattaaatagacttcagaattaatatatatgggagaatttagttcatgttaaaaaactgaattattaatgaattggtcaataaataaacaatttggcaaaaaatgactgtctagtttatgtgcatatatctgtatgtacatattcatcacatgcaagtacatatgtgtgtctgaatatatatgtatatttatgtgtgtgtgtatagatatatatatatacatacacacacatcaggcatgatgtagttctatctctgttcagttaacttacaaactgtatgtgtgtgtgtatatatataaatagtttgtaagatacacatatgtatatatgtataaccttacctcacagcattcacaaagataaattccagatagattaaaagactaaatgaaaaaaacaaattaaacaaacaaaaactaccaaaatattaaatgataatatacaaaatagtatatctttgtaacgtttatatgttataatcttcagtgagaaagtccttcttaaatgagatgcagaatccaaaaccaaaaaaggaaaacccaataggtttggtcataggaaattttactttcatacaccagacaccataaacaaagttgaagataagcaaaaattatatgcaatatatacataacaaaggatcagtagccctaagagaaactataaattagaaacaaaaaaataaataacccaataaaaatggtcaaagaagatcataggtattttaaaaagaatatatgaagagaagcttactatactactaatcagagaaatgtaaataaagaataacaacatcacataattgtaagaaactacaagaattggatggtgaggtcatctaatagtaaaaagaatagaactagtgataatatcaagtgctgttgatgagttaaggaattagatatttttgtgcactgttggcagagtgtaaataaccaaaatcttttgaagggataatttagcagtgtccatcaaaataaaacacagatcatttccagctaggtgtggtagctcatgcttgtaatcctagcactttgcgatgtcaagttgggaggatcccttcagctcaggattttaagaccagcctgggcaacatagagagactctgtctcaaaaaaaaaaaaagtcatttctaggactctatccctatagatgtacctgcaatcccaacattttgggaggccgaggcaggagtatcacctgaggtcaggagtttaagacctgcctggccaacatggtgaaaccccgtctctactaaaaatacaaaaatttgctgggtgtggtggtgtgcgcctgtaatcccagctactagggaggctgaaacagaagaatcacttgaatccaggaggtggagtttgcagtgagccaagattatgctactgcactccagcctgggtgacaagagtgaaactgtgtctcaaaaaaaaagacatgaacaacactgtttatgacagcactgtttgtaaataacaaaaagtggaaacgatcttaatgtctataaatagaatactggttacttaaaaaaatgtaagggggtttgatatttgacagtggtggggaataaagaaatcttttacattttattctatatgttttattcttttacaagcatttctatttttattatttgtttgtttattatttatttatttttttgtgatggagttttgcacttgttgcccaggctggagtgcaatggcatgatcttggctcctgggttcaagtgatgctcctgcctcagcctcctgagtagctgggattacaggtgcccaccaccacaccaccatgcccagctaatttttgtatttttagtagagatggggtttcaccatgttggccacactggtctcaaactcctgaccccacgcgatctgtccgcctccacctcccaaagttctgggattacaggcatgagccaccgtccccggccttttacaaacatttttcatggattaattgtataattaaaatttcaatgaataaaataattagattgataaaggtaatataataatattatataaaacttgggaaaaagagaagcctgatgtgattaactcaacttctgattccatattagtatatttccaggtgcttttcctaaatattttctttcctcgattgattcatacactttcttgaggacagaaaaccttttggaacattttccaaccagaatgaggggatttcctaaatatatgtaaaaaattcagttgttttagcttttaaaatatagcatattaaaaatattcaccttttcttgggaccattttgtccctgcaatgaaactcaacactagtgtgcataatcctccagatccatgtaaaccaatacgttggctgcctaagacggcagaaacacacatagtcaaaacaaggaatcctctcttcaatgtaagttttttctagaattagatagatatttagaaattagtttatattaaatatataatataagatttgacattatctattatatatttttgaccctctgatattatgtctttaaatgttatattaaatgtctaaaattttgattttctttctcaccatatattttagcagacttactaccaagtaacaaaatttgcaattagtcacgtttcatcttctgccatatctctgatactagtatcagtaatatggttaaagtattactataagtgaagaagaaaagagacccataaaatctccagtttcatataacatatccaatgaattcttaaaaaatatttgaatatctctttggtcaatatgttacagctaaatttggatggaaattacagaaatacaaaagtaatggcatgttttcctttaaggcaggaaatggctaaatttgagtgttgcctttgtcaaaggagagcaggagtgaatttcagtcagaaaatatgcagaaataaatggggacctatttccccctaaaatgtttaagggaaaatttgggggaaattatcaaacatcagtaggcagtttagtagagaaagggaaagtataattcagagggatactctgcattaagtatattttttgatattccttatttgccaaattaagaagcagagactttaatcaaagccattgacctgtatcaatcactgctgtgctcagttttaagtacagagtaggcattggaggctagttttagagaaatagaattaagtattaaatttcatcgaccttaccaaagtttaatattttgaaaaaaatgtctaatactatacttctataaaatagattttgtatttacctggtcttcacttggaaaatatcgaacaaaaaatcccaaaacaattcctgccagcagactaatacatacgttccttatagaggctatggcgttattaagtataccacctgtaggggcacacaataaaaaaaaattcacaaagaagtatcttcacatacactacacatcagaaaagcaaatctaggtggttcatgaagaaaagtaagcattttatagaacaaatatatgcaaatggtctttttatagtgacatatatgaaaacatgtagatctatttagtacgttaaatatatactctcaaataatttaatatatacacacaactcagaaatgtccattatgtaaataggccagaaaacaaagacttaacaagcacaagatgctccccttacatagccaacttaaaagacagagtgaggtagtccaggcacagtggctcacgcctgtaatcccagtgctttgggaggctgaggagggtggattacttgaggtcaggagttcaagaccagcctggccaacataatgaaaccccatctctactaaaaatacaaaaattagctgggcatggtggcacacacctgtggtcccaggtactcgggaggctgagggaggagaatcacttgaacccgggaggcagagtttgcagtgagctgagatcgtgacaccacactccagcctgggtgaaagacggaggccacacctccaaaagaaaaaaaaaaaaagactaagtgaggtacaagaatggagagagaccgaaacacttgtggcacttagcatatggctgttaagggctatattaacaattcttctttcatgtactatatgaaaaagaaacaaatgattttaacatgaaaagaacaatgtaataacaacataaaaaattttgttccagggtcagtcctagaaacattcaagggtcaattaagatttcagtatatttaagtatctgcttttggtgaagaaaaaaggaaaaaaaatacaaaagattccagtatattttatattcattaatattaatatatccatacttgtagttcattgtaataagtaaaaaacaaaaaataaaaaaacaaaatgagtcacaaaaatagttcagttaagctctgggtagtggattcaatatagtaagtaagtatatttttagacatattttctactaaatataacaggcagggcatggtgggctcacacctttaatcctagcactttgggaggccaaggcagaaggattgcttgagcccaagagtttgagaccagcttgggcaacagagtgaaaccccatctttacaagaaaataaaaaactagcccggtatgtggtgtgtgcctatagtccaagtactcagtaggctgagggaggaggtcccttgagctcaggagtttgaggctgcactccagcctggctgacagagcaagatcctgtctcaagaaaataaaatacaataaaaataaaaaataatataaacagagagatgtcagccagatggtggaatggggagctccaaaccttgattctccataaagataccaactgaacaacaatatatggtctaaaagcctttatggagttccataaaccattaagaagctgtagtagcacagacaagtgcaaagccaagaatagtggcattgaacaaataagaaaagctgttgcattatactcatgataccccttccccaagctggaacaggttggtgtggctgggaagcactcaacttgcagcttctccattagcagggaaagagaagactggaacggaatagttttatgaggttacctgaagctctctctctctctctaacttgacacccaactggcatactttggatgcgtgggagccactgggaataaaggagaggtcagagatgatgcagcaccagggaacctgcagtgccacagacagataccagagagaacaacagctccagaaaaagaaactggcaaacctctacttgggatgttgcaatgtataaacccaaagaagatgcattcccagaaaaggtttgagaggctgctagaacctatagccatgctgattcaggtaaaggtcttccgtatgaagccagctgataaaaactgggagcagtggcagttttttcaaacgtccaaatcttggcaaaaataagtaaaaaataaaaaaataaaaaataacaggcataagaagaaacagagaaacctgatgactaaattaaaggagcaaaataaatctccagaaaccaatcctaaagaaatagataaatgagttacctgacaaagaatccaaattaactctcttaatgaagcccagtgacaacagaaatagataactaaatgaaagcaggaaataattcatgaacaaaatgaaaatattaacaaagagatagaaactaaaaaaaaaaaaaaaaaaaaaggaaccatacagaaactctgaagctaaggaatacaacagctcaattgaaaaattcactattggaaatcaccaacagactgtgtaactgcccaatgggttcaccttgtgccctgcttagacagagctgatttatcaagacaggggaattgcaatggagaaagagtaattcatccagagccagctgtgcgggagaccagagttttattattactaaaatcagtctccctgagcattcggggatcagaagttttaaagataatttggcaggtaggggcttgggaagtggggactgctgattcatcaggttggagatgaaatcatagggggttgaagtgatgttttcttgctgtcttctgtttgtgggtgggatggcagaactagttgagccattattaccagtctgggtgcactggatgaatcagccagtgcagggtctgcaaaatatctcaagcaatgattttaggttttacaatagtgatgttatccccaggagcaatttggagaggttcagactcttggagccagaggctgcataacccttcaactgtaatttctaatgctatagctaatttgtttatcctgcaaaggcagactggttccaggcaagaaggggatcttttcaggaaatggctattatcaactttgtttcagagtcaaaccatgaactgaataccttcccaaaattagttcatccgactgccaggaatgaacaaggacagtttaaatgctagaagcaagatggagttgattaggtctgatgtctttcactgtcataatttcttcagttgtaatttttgcaaaggcagtttcaataacatcaagcagaataaagaatcagtgaaacagaagactagtcatttgaaattatggagtcagaggagcaaaagggaaaaggaatgaagagtgaagacagcctaagagacttataggatgccatcaagcagaccaatgtatgtattatgaaagtgccagaagaagagaaaaataaaggggcagagagccagttaaaaaaatgaccaaaaacttctcaaatttaaagaaggaaatggacatacaaatccaagagtctcaaagaactccaagttggataatttgcaaaagacctacaatgagacacattacaatcaaactgtcaaaagtcaaagacaaagagagaattttgaaaggaacaggatcaaagcaacttttcacatacaagggagatgccatatggttatcagtggaattctcagcaaaaactctacaggccagaagagaatgggatgatatattaaaagggctgaaagaaaaaaaaaaaactgtcaaccaagaactgtatagccagtaaaactgtacttcaaaaatgaaggacaaacaaagagttccccagagaattaaaaggtgagggaattgatcaccactagacctaccttacaaaaaatgttaaagggagtcctccatgtggaaatgaaagggcattggatagaaatacaaaagcatacaaaacataaacttctttggtaaaggtaaatatatgagtgaacatagaatcctttaatactgtaatggtggtaagtaaaacactttttttctttacttttttctttttcttttttgagacaaagtcttgctctgttgcccaggctggagtgcagtggtttgatcacagctcactgcagccttgcaggcctgggctaaagcaatcctcccacctcaacctcccaagtggctgggactacagacatgcaccaccacactcagataatatttttaaatttttagcagagataaggtcttgctggtctcaaactcctaggctcaagtggtcctcccattttggcctctcaaagtgctgggactacaggtgtaagacaccacacccagcctgtaattcacttttaattgaagcatagaatttaaaaagtaaaagcataacattactgtattaaattatgtgaataaacaatataaaaatatatattgtgtgacactgataacaaagtgagaaggaagtgtaaagaagtagagtttttgtatgtgattaaagttaagttgttgtcaatttaaaatagattattataactatgagatgttttcatgtaattctacagtaaccacaaagaaaagacctacagaagatacacaaataaacatgagaaaggaacccaagcatgcccctaccaaaaaaagaaatcagtgaaacataaagggaggcaggaagagaggaaaagtggaaaaaaatagctgcaagacatacataaaacaataaacaaaatgacaatagtaagcccctccctatcagtaactactttaaatgcaaataggctaattttccaatcaaaagacagagattggccaaatggatttaaaaaaatctaaatatatactatatgcaagagacttacattagatctaaagacacacaaaggttgaaagtgaaaggatggaaaaagatattcaatgcagttggtaaccaaaagagaacaacgatggccatacttagacaaaatagagtttaagtcaaataatagcacaagagacaaggatattacataataataaaagggccaattgaccaagaagatatagcaattataaatatatatgcaactaacagtacagcatctaaatatatgaagccaacatagacagaattgaggggtaacatagataacaacatcataataacagaaaacttcaatatcccactttcaattatggatacaataaccagacagaagatcaactggaaaacagagaacttgaacaacactgtagaccaattggacctatctgacatatacagaacacttcacccaataatagcaaaatacactttcttctcaagtacataccaagacttttccaggataaatggcatgctagtccacaaacaagtttttaaaaatttaagaaaactgaactcataccaagtatcttttctgaccacattaaatgaaattagaaattcatagcagaaggaaaaaggaaaagtaataaatatgtggaaattacaaaaatatactctgttaaccaattggcctgtatggttaatattaattgtcaatttgattgagggatgcttagatgcctgatgaagcactgagtgagggtatatctgtgagggtgctgccacaggagaatgatggatgagttagtggactgagagagaaagacccatcctcactgtgggtaggcatcatgcaattggttgcaagtgtggctagaacaaaaaggcagaagaatgggaacattcagcttgcttggatttcttttttatgcactttctctctcttccagagcagtatgcctttttctcctcttgcccttgcacatcaaactctaggttcttttgcctttggaccctggaacttgcatcagcagccttttgggagctctcaggcctttggcctcagactagtggctgcactgtcagcttccctggttttgagactttcaaatttggactgagccatgtcactggcttccttgggagccatgctttaggcttctctcattttccggcttatagatggcctattgtgggactttgcctttgtaattatgtgagccaattctccttaataaattatatttcatatatatgtaaatatattctcttttatatgcatgtatctatatctatatctatatctatatctatatctatatctatatctatatctatatctatatctcctattggttctgaccctctggagaactctgattaatacatagtcaaagaataagtcacaaggaaaattagaaaatgtctcgagacaaataaaaatggaaacacaacattccaaagcttgtgggatgcagcaaaatgaatatgaagaggacagtttatatatctaactacctaccttaaaaaagaagaaagatctaaaataagcaacttagctttacacctcaagaaactggaaaaagaagaactcaatccaatgttagcaaaaggaaggaaataataaagtctagagcagaaggccgggtgcaatggctcacgactgtaatcccagcactttgggaggccgaggcaggcagatcacctgagatcaggagtttgagaccagcctgagcaacatggagaaacctgtcactactaaaaaatacaaaattagccaggcatggtggtgcatgcctgtaatcccagctactctggaggctgaggcaggagagtcacttgaaccgggaggcagaggctgcactgagctgagatcgtgccactgcactccagcctgggcaataagagcaaaactccatctcaaaaaaaaaaaaaaaaaaaaggctagagaaaaaaaaaacccaatgaaactagtagttgtttcaaagttcaacaaaattgacaaataatcagctagaatatttaagaaaaaaaataaagaagactcaacttcttttaggaacaaaagagaagacattgcaacagatattacagaaataaaaaggattctaagagtctactatgaatgattatatactgacaagttggataacctaggagaaatgaacagattcctagtaacatgcaagttaccaagactaagtcacaaaataaaaaatcttaatagacctataactagtaactgaatcaggaatcaaaaacctcccagcaaaccaaatacctgataaggggttaatatctaaaatatatacagaacaacaactcaataacaaaacaacataatgagaaacggtcagttgactttgctatggtccaaatgtttatgttctcccaatattcatatgctggagcctaatattcaatgtgataatattaagaggtggggcattttggagatgattagttcatgaagtcatagccctcagaaatgggactagggcctttataaaagaggcttaagggagtttactttcccttttgaacatgtgaggacaaagagaaggtgctatctatagtgaatatagtgacctcaccagtcactgagtctgttgtagcctaaatcttggacttctcacattccagaacgcaagaaataaatttctgttgttcataaattaccagcctaaggtattttgttatagcagcaggaatggactaagatagacttgaacagacattttttccaaaaaaaaatacaaatggccaactagcatatcaacccgacactatgtggcagctgccaaggcttggggattgaactctctgaagcaatagcctgagctgtatgttggctccttttagccatggctgggacatagtgcagtcccaagactgcacagagcagcaaagctctgggcctggcccacaaaaccattttttccctcctaggcctccaaccctgtgacgggaggggctgttgtgaagaactctgacataccctggagacaatttccccattatcttggcaattaacattcggctccttgttacttctgcaaatttctgcagtcagcttgaatttctccccagaaaatgggcttttcttttctatcacatcataaggctgcaaatcttccaaacttttatgctctgtctcccttttaaacataagttccaattccaaaccatatttttgtgaatgcataaaactgaacacttttaagagcactcaggtcataaactgaacactctgctgcttagaaatttcttctaccagatgtcctgggtgggttccaagatggccaaataggaacagttccggtctgcagctcccagcatgatcgacgcagaagacaggtgatttctgcacttccaactgaggtacctggttcatctcattgggactggttggagagtgggtgcaggcccacagagggtgagctgaagcagggtggggcatcacctcacccgggaagcacaaggggttgggggatttccctttcctagccaagggaagccgtgacagactacctggaaaaacagggcactcctgcccaaatactgcacttttcccaaggtcttagcaactagcagacaagatgattctctcccgtgcctggctcagcgggtcccacacccatggagccttgctcactactagcgcaacagtctgagatccatctgcgaggtggcagcctggctgggggagggccgtccaccattgctgaggcttaagtaggtaaacaaagcggctgggaagcttgaactgggtggagcccactgcagctcaacaaggcctattgcctctagactccacctctgtgggcagggatagctgaacaaaaggcagcaacttctgcaaacttaaacgtccctgtctgacagctctgaagagagcagtggttttcccagcatggcgtttgagttctgagaatggacagactgcctcatcaagtgggtccctgacccctgtgtagcctaactgggacacacctgccagtaggggctgacagacacctcatttaggcggatgcccctcttggacgaagcttccagaggaaggatcgggcagcaatatttgctgttctgcagcctccactggtgatactcaggcaaacagggtctggagtggaactccagcaaactccaacagacttgcagctgagggtcctgactgttagaaggaaaactaacaaacagaaaggaatagcatcaacattaaccaaaagatcatctacaccaaaaccccatctgtaggtcaacaatgtcaaagaacaaaggtagataaaaccaaaaggatagggataaaccagagcagaaaagctgaaaattctaaaaatcagagcacctcttctcctccaaaggatcgcagctccttgtcagcaatggaacaaagctggatggagaatgactttgacgagttgacagaagtaggcttcagaaggttggtaataacaaacttctccgagctaaaggaggatgttggaacccatcgcaaggaaggtaaaaaccttgaaaaaagattagatgaatggcttacaagaataaacagtgtagagaagaccttaagtgacctgatggagctgaaaaccttggcacgagaactttgtgacacatgcacaagcttcaatagccgattcaatcaagtggaagaaagggtatcagtgattgaagatcaaataaatgaaataaagtgagaagacaaggttagagaaacaagagtaaaaagaaatgaagaaagcctccaagaaatatgggactatgtgaaaagaccaaatctacatttgattggtgtacctgaaagtgatgaggagaatggaaccaagttggaaaacactcttcaggatattatccaggagaacttccccaacctagcaaggcaggccaacattcaaattcaggaaatacagagaacaccacaaaaatactccttgagaagagcaattccaagaaacatacttatcagattcaccaaggttgaaatgaaggaaaaagtgttaagggcacccagagagaaaggtcaggttagccagaaagggaagcccatcagactaacagtggatctctcagcagaaaccctgcaagccagaagtaagtaggggccaatattcaacactcttaaagaaaagaattttcaactcagaatttcatatccagccaaactaagcttcataagtgaaggagaaataaaatcctttacagacaagcaaatgctgagagattttgtcaccaccaggcctgccttacaagagctcctgaaggaagcactaaacatggaaagaaacacccggtaccagccagggcaaaaacaggccaaactgtaaagaccatcaatgctaggaagaaactgcatcaattaacgggcaaataaccagcaactatcataataacaggatcaaattcacacataacaatattaaccataaacgtaaatgggctaaatgccccaattaaaagacacagactggcaaactggataaagagtcaagacccatcagtgtgctgtattcaggagacccatctaacgtgcagagacacacataggctcaaaataaagggatggaggaagatctaccaaacaaatggaaagcaaaaaatagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaagagcacccagattcataaagcaggtccttagagacttacaaagagacttagactcccacacaataataatgggagaatttcacaccccactgtcaatattagaaagatcaagaagacagaaggttaacaaagatatccaggacctgaactcagctctgcaacaaacagacctaatagatatctacagaactctccaccccaaatcaacagagtatacattcttctcagcaccacatcacacttattctaaaattgaccacataattggaagtaaagcactagtcagcaaatgtaaaagaacagaaatcacaacaaactgtctctcagaccacagtgcaatcaaattagaacttaggattaagaagctccctcaaaactgaacaactacatggaactgaacaatttgctcctgaatgactactgggtaaataacaaaatgaaggcagaaataaagatgttctttgaaaccaatgagaacaaaggcacaatgtaccagaatctctgggacacatttaaagcagtgtgtagagggaaatttatagcactaaatgcccagaagagaaagcaggaaagatctaaaattgacaccttaacatcacaattaaaagaactagagaagcaagagcaaacacattcaaaagccagcagaaggcaaaaaataagatcagagcagagctgaaggagatacagacacaaaaaacccttcaaaaagtcaatgaatccaggagctggttttttgaaaagatcaacaaaattgacagactgctagcaagcctaataaagaagaaaagagagaggaatcaaatagatgcaataaaaatgataaaggggatatcaccactgagcccatggaaatacaaactaccatcagagaatactataaacacctctatgcaaataaactacaacatctagaagaaatggataaattctgggacacatacacccttccaagactaaaccaggaagaagttgaatctctgaatagaccaataacaggctctgaaattgaggcaataattaatagcctaccaaccaaaaaaaaagtccaggaccagatggattcacagctgaattctaccagaggcacaaagaggagctggtaccattctttctgaaactattccaatcaatagaaaaagagagaatcctccctaattcattttatgaggccaacatcatcctgataccaaagcctggcagggacacaacaacaacaaaaaagggaattttagaccaatatccctatgaacattgatacaaaaatcctcaataagatactgacaaactgaatccagcagcacatcaaaaagcttatccaccacgatcaagttggcttcatccctgggatgcaaggctggttcaacatacacaaatcaataaatgtaatccatcatataagcagaaccaaagacaaaaaccacatgattatcttaatagatgcagaaaaggcctttgacaaaattcaacagcccttcatgctaagaactctcaataaactaggtattgatgggacgtatcttaaaataataagagctatttatgacaaacccacagccaatatcatactgaatggacaataactggaagcattccctttgaaaactggcacaatacaaggatgctctctctcatcactcctattcaacatagtcttggaagttctggccagggcaatcagggaagagaatgaaataaagggtattcaattaggaaaagaggaagtcaaattgtccctgtttgcagatgacattattgtatatttagaaaaccccatcatctcagcccaaaatctccttaagctaagcaacttcagcaaagtctcaggatacaaaatcaacgtgtaaaaatcacaagcattcttatacaccaataacaaacagagagccaaatcatgagtgaactcccattcacaattgcttcaaagagaataaaatacctaggaatccaacttacaagggaaatgaaggacctcttcaaggagaactacaaaccacttctcaacgaaataaaagaggacacaaacaaatggaagaacattccatgctcatggataggaagaatcaatattgtgaaaatggccatattgccaaaggtaatttatagattcaatgccatccccatcaagctaccaatgactttcttcacagaattggaaaaaactactttcaagttcatatggaaccaaaaaagaacctgcattgccaagacagtcttaagccaaaagaacaaagctggaggcatcacactacctgacttcaaactacactacaaggctacagtaaccaaaacagcatggtactggtgccaaagcagagatatagaccaatggaacagaatagagccctcagaaataatacgacacatctacaaccatctgatctttgacaaacctgacataaacgagaaatggggaaaggattccctatttaataaatggtgctgggaaaacgggctagcaatacgtagaaaactgaaactggatcccttccttacactttatataaaaattaattcaagatggattaaagacttacatgttagacctaaaaccataaaaaccctagaagaatacctaggcaataccattcaggccataggcatgggcaaagaattaatgactaaaacaccaatagcaatggcaacaaaagccaaaattgacaaatgggatctaattaaactagagagcttctgcacagcaaaagaaactaccatcagagtgaacagacaacctacagaatgggagaaaatttttacaatctacccatctgacaaagggctaatatccagaatctacaaataacttaaacaaatttatatgaaaaaatcaaaccccatcaaaaagtaggcaaaggatatgaacagacacttctcaaaagaagacatctatgcagccaacagacacatgaaaaaatgctcatcatcactggccatcagagaaatgcaaatcaaaaccacaatgagataccatctcacaccaattagaatggtgatcattaaaaagtcaggaaacaacaggtgctggagaggttatggagaaataggaatgcttttacactgttggtgggagtgtaaactagttcaatcattgtagaagacagtgtggcgattcctcaaggatctagaactagaaataccatttcacccagccatcccattactggtcatatacccaaaggattatgaatcatgctgctataaagacacatgcacacgtatgtttattgtggcactattcacaatagtaaagacttggaaccaacccaaatgcccatcaatgatagactggattaagaaaatgtggcacatatacaccatggaatactatgcagccataaaaaggatgagttcctgtcctttataaggacatggatgaagctagaaaccatcattctgagaaaactatcacaaggacagaaaaccaaacaccgcatgttctcactcataggtgggaattgaacaatgagaacacttggacacagggtggggaacatcacacactggggcctgtcatggagtgtggggagggaggggatagcattaggagatatatctaatgtaaatgacgagttaatgggtgcagcacaccaatatggcacatgtatgcatatgtaacaaacctgcatgttgtgcacatgtaccctagaacttaaagtataataacaaaaaaaactatgacactgtcctatataccatatctgtacaaaaattataaattttagatagccatccagagatacttctctacttcttggaaaaaatatcaacattgaaaacatcaaaaaaattaaacacttcttcttttgtccaaaaaaaaaaagaaagaaaaaagggaatcctccctaactcattttatgaggccagcatcatcctggtaccaaagcctggcagagacacaacaaaaaaagagaattttagaccaatatccctgatgaacatcgatgcaaaaatcctcaataaaatactggcaaaccgaatccagcagcacatcaaaaagcttatccaccacgatcaagtcggcttcatctctgggatgcaaggctggttcaacatatgtaactcaataaacataatccattacataaacagaaccaaagacaaaaaccacatgattatctcaatagatgcagaaaaggcctttgacaaaattcaacactccttcatgctaaaaactctcaataaactaggtattgatgggacgtatctcaaaataataagagctatttatgacaaacccacagccaatatcatactgaatgggcaaaaactggaagcattccttttgaaaaccggcacaagacaaggatgccctctctcaccactcctattcaacatggtgttggaagttctgaccagtgcaatcaggcaggagaaagaaataaatggtattcagttaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccattaatagacaaacagagagccaaatcatgagtgaactcccattcacaattgctacaaagagaataaaatacctaggaatccaacttacaagggttgtgaaggacctcttcaaggagaactacaaaccactgctcaacgaaataaaagaggacacaaacaaattgaagaatattccatgctcatggataggaagaatcaatatcatggaaatggccatactgcccgaagtaatttatagattcaatactatccccatcaagctactaatgactttcttcacagaattggaaaaaaaactgctttaaagttcatatggaaccaaaaaagagcctgcattgccaagacaatcctaagcaaaaagaacaaagctggaggcatcacactacctgacttcaaactgtactacaaggctgcactaaccaaaacagcatggtactggtaccaaaacagatatatagaccaatggaacagaacagaggcctcagaaataagaccacacatctacagccatctgatctttgacaaaactgagaaaaacaagaaatggggaaaggattgcctatttaataaatgatgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggccataggcatgggcgaggtcttcatgactaaaacaccaatagtaatggcaacagaagccaaaattgagaaatggaatctaactaaactaaagagcttctgcatagcaaaagaaactgccatcagagtgaaccaggcaacctacagaatgggagacaaattgcgatctacccatttgacaaagaaagaattcaaacaaatttacaagaaaaaaacaataccatcaaaaagtgggcaaagatatgaatagacacttctccaaagtagacatctatgcagctaacagacacatgaaaaaatgctcatcatcactggtcatcagagaaatgcaaatcaaaaccacaatgagatatcatctcatgccagttagaatggcaatcattaaaaagtcaggaaacaacagatgctggagagcatatggagaaataggaacacttttacactgttgatgggagtgtaaattagttcaaccattgtggaagacattgtggcgattcctcgaggatatagaactagaattaccatttgacccggcaatcccattactgggtatatacccaaaggattttaaatcatgctactataaagacacatgcacatgtatgtttatttcggcactattcacaatagcaaagacttgtaaccaacccaaatgtccatcaatgatggactggattaagacacgtgacacatatacaccatggaatactaatgcaatcataaaaaaggatgagttcatgtcctttgcagggagatagatgaagctggaaaccatcactctcagcaaaactatcacaaggacagaaaaccaaacaccgcatgttctcactcataggtgggaattgaacaatgagatcacttggacacagggctgggaacatcacacactggggcctgtcggggggtggagggctgggggagggagagcattaggagaaatacctaatgtaaatgatgagttgatgggtgcagcaaaccaacacggcacatgtatacctatgtatcaaacctgcatgttgtgcacctgtaccctagaacttaaggtataacaacaccaacaaaaaaagaagtttcttctaccagatgtcctcaatcatctctctcagtttcaaagttccataaatctctagggcaggggcaaaatgccaccagcctctttgctaaagcatagcaagagtgacctttacttcagttcccaacaagttctttatctccatctcagacctcctcagcctggacttcactgtccaagtcactatcagcagttcggtcaaagccattcaacaagtctctaggcagttccaaactttcccacatcttctggtcttcttctgagtcctcccaactgttccaccctctgcacattacacagctccaaagtcacttccacattctcaggtattttatagcattactccattaccttggtatcaaaatctgtattagtcatggttctctagagggatagaactaataggatatatgtatgtatgaaagggagtttattaaggagaattgaatcacaccatcacaaagtgaagtcccacaacacgtctgcaagttgaggggcaaggaatctagtattggctcagtccgagtcccaaaacctcaaaagtagggaaactgacaggccagctttgagtctctggatgaaggcctgagagtccctggaaaacaactggagtaagtccaagagtccaaaagccaaagaacctggagtctgatatttgagtgcaggaagcatccagcatgggagaaagatgagggccagaaagctcagcaagtcagcttctcctaaacttcttctgcctgctttattctagccatgctggcagctgattttatggtgccgacccacactgagggtggatctgcctctcccagtccactaaataaatgttaatctcctttggcaacaccctcacagacacaaccgggaacaatactttggatccttcaatccaatcaagttgacacttacttaatattaatcttcacaatgtaatattcatcccatttgtaatttttctttaatatacaagctccttgagaacatgcaccatttgatcttgtctctctgttttcttgggaggcagtggagaagagaagagttaaatgtgtgggtgtggagtcagactgccagatttgcatcttggctcccctacttactggatctctgaccttgagtaaattacttaacatctttctcagtttccttacctgtaaatgagtggtgacatatatggaacttagaacaagagccaagcaagtattcaataaaagctaatgttgttgcctactgtttattctcagtgtttggcatagtagccggcaaaaggaagaggaattttttttttctttttttcagacagtctccccctgtcacccaggctggagtgcagtggtgtgatcttggctcactgcaacctctgcctcttgggttcaagcaattcttgtgcctcagccccctgagtagctgggattacaggcctgtgccaccacacccagctaactttttgtatttttagtagagatggagctttgctatgttggccaggctggtcttgaactcatgtcctcaagtgatccacccactttggcctcccaaagtgttgggattataggcgtgagccattgggcccggcctggaaatatttttttgaaacatgactgataacagtattttttgaaagaatgacagataccaatcatgaaggaaaagattttcacaattgacaataaaaaactttaacttctgaatggtaaaaagagtgagaaaattaaaagccaaattacaaattgaaaaaactaaagtatataaaacaaaggttttcattctcaatttaatgcagaatcttgacaaatcaaaaagaacaaaaggtgaacccacctaaaagaaataggcaaaagacttccaagaaaagcaatttacaaaatgccaatgactaataaacatggatatttaacagcactagtattcaaaatacttcatttatagagatccctccttcacctatcaaattagcaaagatgaaaaaggctagtattaccaagttttgaagacaggtgagaggaaatgacaagtttatgtaccctggtaggacatgatattgtggcaatttgtttcagaacactcataaatgtagatatcttttagatcaacaattacacttttaagcttaagaaaatatgaagaataggtacaaatatttctctatatgttcaattaagtattattttttaaattaaaaaaaaattttttttgagacagtgtctcactctgttgcccaggctggatagctcactacggcctccgcctcctgggttcaagtgattcttctgcttcagcctcctgagtagctgggattacagatgcccaccaccatgcctggctaagttttgtatttttagtagagacagggtttcaccatgttggttggccaggctggtcttgaactcctgatctcaagtgatccacccttcttggcctcccaaagtgctgggattacaggcatgagccaccatgcctggccaattttttaattaaaaaaaatttttatagcagcacaactaagtattattttaatagtaaatattggagtcaagtttaattttgaacaggataagtaattatgatgcagcacattgaatactctttcattaagctaaacaactattaaaatgatatacaaatacatttactgaaaagaaacatgtttgtgatatacagttaagtgtaaaacaattcaggttataagaacatattaggccaggtgcgatgtctcacgcctgtaatcccagcactttgggaggccgaggcgggcggatcatgaggtcaggagattgagaccatcctggctaacatggtgaaaccctgtctctactaaaaatataaaaaaaattagccgggcgtggtggtgggtgcttatagtcccaactacttgggaggctgaggcaggagaatggcgtgaacccgggaggcagagcatgcagtgagccgagattgtgccactgcactccaacctgggtgacagagcaagactccgcctcaaaaaaaaaaaaaagaacatattggtcaatattcactgatttttataagaatatttgacagagagagagggggaagggaagggaaggggaaaggaaagggaaaggaagaagggaagaagggaagggaagggaatatgggtggatttatatcaaaaggttcagaaggaaatgattcttttcttctggatgtgactactgcagatttttttaacttttcctctttttcttatttatttatattttctgattttaagagaaactataaaactatatatattacttttcaacttaaaaatattttagtgcttcaataatgcagaagactcaatttcaacattgcagataattaaagcattactaaatgtggaaatgtttactttcacaatttctgtagtgatattcaagaccagatatcaccttggaatcagaactggtgcaggatcttgtcctaacactaccattaaggcatatggctgacccagctctgtatgtttaggttgtcttataatagagcaaccagttgtttattaggatggccaaaaaggcacatttcaaaaatgcctattaaaatattagtagtacaaataataccgctgaattttttctaatgagaactgataaaattccaaagcaatataagcagatacatagtaataatatggtttatcaaattaattgtcacatgattattaaaatgagatcatgtgtgttaagtagtggtatcttaagccactgaaatatcttccttggtctagaatgagctttctatggagattaaaaagatgttaaattgaacagtcttggttaataaatgaagaagcaaagccagaaaccctgtttaaagaagtaacaaaaaaggtcatgaatgatctagtggttgttatattttcttgtttacctgaggaaaagactatgctcaagcatgtattgaatccagtgatagccagaatgtcatccatactgctagcagccattaataaggttggaatgccttcctcaacaccatatccattttcttgcagcaccatcatgtaagggacaacaacagcaggagagacagcacctagaacaaaactgaaagaaagaatgaaaattaatttaaaagcatcttttaaatcaagtagtgttttataagtacaagtagtttataataactttataacaaacattgtttagaagaatttcaaatttgagtgaatgcaatttaatggtgataaaacttttcatgcattgtttagtgctggctaaaattttatacagatgtggtttaaaatgttgggctgaacacaggttgcagcctctccctctattcctaaatcctttgaagtgaagatgtaaaagtaatagaaaaattcataacctaaccagaaagcaaaaggtgaatccgcaatggacaagaaactaagtatatcccagtaagataagagacagacaatttaggattgaaaaaaggaaaccataaaccaaaatctgtgtaaataagattgcctcaaaagatacatgtgcttctaaaagtgctccaagccctgaaatggcagatgctgggagcaggagagacctctggggaaaccaaatagttaattatttggagtaccactgtaagaatggtcagacaaatctatcttccacacatttcctacctcttgagtaaataagtaagtaaggaaggaaggaacagagttgtctgcccaaaaaaacaagtgtggccacctaagttacaaaggcaaatgagaacatttctggagtggttgatgacacccatgaggaatggggaggctcctgctccgaataccttctattgacatatcttatccagaatttcgcctcatctcttctacatttactttataaaggctgaagtatatcctgtgtagaaatgcttttggtgctcctgccagaattgacctggtaaatgaacacatctcccagtgctgcttgttggctgctaatatctgcagatttctagaacccttgtcctgctgacaagcacctacctgggaatactagggaggttgtgcacccctctactttccctccagacagcatctgccaatgactgactgatgtgagtgtctaatagtttagcccatttgcttctggctgtacaacctctatggtgcagtttatgctacagatttccctgtgggctcaagaagagactagacttctctaagaccacatactggtctagttcagtggttcctaaactctgctgcacattgtaatcacctgttgtattatttttctcattttgcttaacaagtcatccccaaacatagcagcttaaaacaacaaatatttattgtcttatgacttctgtgggtcaggaatctgggcatggcttagctgtatgccttcacttaagatttcccatgaggtagggtggggtgggagaagatctgcttccaagtttactcatgtagctattgcaggcttcagttttttccaatggggttttctccacagggctgcctcaggacatggcagctggcttccccaggaataagtgatcaaagagaatttaatccataacatcaattaaaaacacaaaatatctaagaaaaaaactgtgaagatagtctatacttttataaaaattgtgaatataataatataataattaagataatacctgaatacttagagagacatttcacaagtgtgaactaaaaagcctcaattttaccatcgcccaacaccacgtctggctagtttttgtgtttttagtagatacggtgtttcaccattttggccaggctggtcttgaactcctgacttcaagtgatatgcccaccttggcctcccaaagtgctgggattataggtgtgagccaccatgcccggccaaagcctcaataatataaagatgtaatctctcccccaaataaattaatcagagatacaccaatcaaaatctttgcagggatttttactgagcttgacaagctgattataaaattcatttggaagaataagatcttagaacaaaagatcaagtaaacttaagaaaacaagatactgtttttgtaagggtaaaatagttaaaactgaataatagtgacatataaatagacaaaataaattggaagaaaagaaaatacaatgtgtggaaacaaatctatgggatttgttacatcatacaattggtattttaaatcagtgggagaaagaaagaaatctttcataaatggtgttgagataactatttatgtggaaaggaatatagatagatccttacacataataaatgttaaaagctcaaaaggaaaagtagtaataagaaaatgtagggggctaggtgcgatggctcacacctgtaatcccagcactttgggaggctgaggcggacagatcaggagtttgagaccagcctggccaacattgtgaaaccaatagctgggtgcagtggtgcatgcctgtagtcccagctacttggaaggttgaggcaggagaatcacttgaacccgggaggtggaggttgcagtgagctgagatcacgccactgcactacagcctgggtgacaggaagactctgtcacaaaaaaaaaaaaaaagaaaatgtagaataatatatttgtgatcatgaggtaaaaaggaccttttgaatgatacatacaaaggcattagacataaaaagagattttgatacattcaattatattaaagtagtacttcaaaagcaacttcaaaagtactacaataaagtactacttcaaaagcaattctgctctttctccccctttttttctttttcattttcaaagtcaagtgaatggtgttgtgtattggcaattctgtctgttgaaaataacaaaatacacttcttagagagaaaaaaaatcatcacaaacaaaattaaatatctagtgatatttgcaatacatataatttacaaatacatataacagatataattaataaagaagttgaagactcaacaaaaaaatggacaaaggatatgaacaggctagttacagataaggaaaagttgaaggacaacacatatataaaagatattcaagtttgtgaataatcacagaaatgcaaattaaaacaacaaaaatatgccattttttcaattatcagatgtgaaaacattataaaatttaataatatcaaggatttgcaaggattttcaagaacaacaggtatgctcataagctattggtattagggcaaattaaagtggccataccgaagggattttggcagtgtatatcaaactaaaaatgcatataacccaggtaactattctagacaaacttatatttaagtaaaatgagacaaataaaatgctatttttgttataacattgtaaataaaatctgctgttgacatacaatgtagtcttatacaattaaaaggaataaactacgtgtgtatccatcttgagatggataaacctcaagactattgttaagtgaaaagaacaaattgtaaagtaaaattttcttgggtatgattaagtaaaaatgcacaaaataatactcttttttttctctgggttcacaaatacacttgttagaagtccagaacattattttcaaagatctagaatggtaacataaaactcacgaagatgctgccactctgtccccagtggcacatgagtgcaccccacagcaccattgccctggctgacccatgcaagtatgcagaacaaccccatcccacacctgccggcactgcacccctgccaacacaggcatacctgctgtgtgctgctgctgctggcacatatgtgtgagtagggaccttgctacaatcactacaatgaagcactctggctggcacaccccatcagagtgttgttgccagtggactgggaacacctcagtgcttaacactgaagggccagacaacaaatctgtgggtatggtaccagccctgcaaagttagagcatgcagctcaggagtgctgagctgagcctttgccccctgaaatcttccagaaatgaagccatttgactgaacctaccttgtgccacagtcaaaccctcaagggcattaaagaatataaaaaaggaaaaagctccatccaaaggacagtgactcaaaacattaaaggaaccttagcccacacagatgtgaaagaaccagtgcaaaaactggcaatgtaaaaagccagaatgtcttcctgtcttcaagcaatcatactaactctctaacaatggttgttaaccaggattaaatgacagacatagaattcagaatctggatagaaacaaagatcattgagattcagaagaaagtcaaaatccaatccaaataatctaaggaatccaataagatgacataagagctgaaagatgaaataggcattttaagaaagaaccaaactaaactgatagagctgaaaaatgcgcctcaagaatttcataatacaataacaagtactaacagcagaacagaccaagctgagaaaagaatcttagatctcaaagaccacttctttgaattaactcagtcagatgaaaataaagaacaagaaagaatgaacaaaacctctgagaaatctgagattatgtaaagagaccaaacatatgactcaaggcatcactcaaagaaagggagaaagaataagcaagttggaaaacatatttgaggatactgcccacaaaaatttcccaaatcttgctagagaagtcaccatttaaatccaggaaatgcagagaacccctgtgagatactacataagatgaccatccccaagacatccccaagtcatcagattctccaaggtcaacatgaaagaaaaaaacatgaaaggcagctaaagtgaaggggcaggtcacctacaaagggaatcccatcaggctaacagtggaactgtaagatactctacaatccaaaagaaattgggggcctatattcagcattctttctttttgtttttgagatggagtctcactctgttgcccaggctagagtggactggtgctatcttggctcactgcaacctccacttcccgggttcaagcgattcttctgcctcagcctcccaagtagctgggactacaggtgcgcaccacaacacctggcaattttttgtaattttagtagagacgggatttcaccatattggccagggtggtctcaaattcccaacctcgtgatctgcccacctcggcctctcaaagtgctgggattacaggtatgagccaccatgcctggccttcagcattcttaaaaaaaaaaaaaaaaaaaaaaaaaaaaacttggctgggtgtggtggctcatgcctgtaatcccagcactttgggaggctgaggggggtggatcacaaggtcaagagatcaagaccatcctggccaacacggtgaaaccccatctctactaaaaatacaaaaattagctgggcatggtgatgcgtgtctgtagtcccagctactcgggaggctgaggcaggagaatcacttaacccaggaggtggaggttgcagtgagctgagatagcaccactgcactccagcctggcgacagagcaacactctgtcgccaaaaaaaaaaaaaaaaaaaaaattcaaccaagaacttaatatccagccaaactaaacttcatattgaaggagaagtaagatccttttcagacaaacaaatgctaagggaatctgttaccaccagacatgccttacaagaggtccttaaaggagtgctaagtgtggaagtgaaggactgttaatggccaccacaaaaatacgtttaagtacatagaacattgacattgtaaagtaactacacaatcaagtctgcataataaccagctaacaacataatgacaggaccaaagctataaatatcaatattaactgtgaatgtaaacagtataaacgccccacttaaaactcacagaatggcaagttggataaagaagcaaagcccaactgtatctgctgtcaagagacccagctcatatgcaacgatacccattggctcaaagtaaaaggatggaaaaaaatctagcaagcaaatgcaaaacaaaaaagggtaagcattgttatcctaattcagacaaaatagactttaaaccaacaacaatcaaaaagacaaagaagggcactacgtaatgataaagggttcaattcaacaagaagacttaactgtctaaaagataaatgtgctcaaaactggagcattcagattcataaaacaagttcatagagacctatagagaaacttagataaccacagaataatagtgggagacttcaacatctcactgacagtactagacagatcaaagagacagaaaatgaacaaagatattcaggacttgaagtcaacacttggctaaatggacctaacagccatctacagaacactccacccaacaacaacagaatatatgttcctctcatctgtacatggcatatattgtaaaattgatcacactatcagtctaaaattattttcaataaatttaagaaaacccctgaaatcaggccaaccacactcttggacccgcagtgtaataaaaatagaagtcaacactaagacgaactctcaaaaccatacaattacatggaaattaaacaacctgtgcctgaatgacttttgggtaaacaatgaaattaaggcagaaaccaataaattctttataactaattaaaacaaagatacaacattctcggctctctaagacacaggcaaagcagtgttaagggaaaagtttatagtgctaaatgcccatattgaaaagttagaaggatcttaaattaacaacctaatatcatacctaaaggaaacagaaaaacgagaggaaaccatcccaaagctagcagaagaaaagaaataaccaaaatcagagcagaatggaatgaaattgagtcatgaaaagccatacaaaagataaatgaaactaaaagctggttcttcgagagaataaataaattggataggtcactagctagaccaataaggaaaaaaaaaaaagagagagagaagatccaaaaaacacaatcagaaatggcaaagtggacgttaccgccaaccacacagaaatacaaaaaactctcagagactacgatgaacatcttcatgcaaacaaagtagaacacctatgagaaattggtaaatttctggaaacatacaacttcccaagattgaactaggaagaaactgaaatcctgaacaaatcaaaaatgagttctgaaactgaatgagtaataaaaagtctctgagccaaaaaaaaaaaaaaaaaaaaaagcaagcccaggacccaacagattcacagacaaattctaccagaagtgtaaagaagagctggtaccaatgctactgaaattattccaaaaaaatgaggaggaaggatccctccctaactcattttatgaggccagcatcattcagatatgaaaacctggcagagacacaacaaaaaagaaaacttcaggacagttatcactgatgatcatagatgcaaaaatcctcaacaaaatacaagccaactgaatccagcagcatatcaaaaagctagtccactatgattaagtaagctttatccctgggatgcaagtttggttcaagatatacaaaccaataaatgtgattcatcatataatagaactaaaaataaaaacatcccttcatgatatagaccctcaacaaatgagttactgaaggagcatacctcaaaataattggagccatttatgacaaaaccacagccaacttcatactgaatgggaaaaagctggaatactccctttgagaactggaacaagacaaggatgcccactctcactactcctattcaacatagtaatggatgtcctagccagtgcaattaggcaagagaaagaaacacagacatctaaataggaagaatggaagccaaactatgcctcttcataggtgaaacacttttataccaagaaaaccccatagtagcctctcaagagctcccagatctgacaaatgacttcagcaaagtttcaggttacaaaactcaatgtacaaaaatctgtagcatttctatacaccaacaacatccaagctgaaagccaaatcaagaatgcaatcccattcacaatagccacaaaaaaactataaaataccttggaatacagctaagcagggaggtgaaatatctctacaatgaaaattacaaacgagtgctcaaagaatcagagacaacagaaacaaaaggaaaacattccatgatcacagataggaagaagcaatattgttaaaatggccatactgcctaaggctatttacagagtcaatgctattcctatcatactatcaatgacatttttcacaggattaaaaaaagcatcctaaaattcatttggagccaaaaaaacaaacaaacaaaaaaagcccaaatagccaaagcaatcctaagcaaaaagaacaaagccaaaagcatcacactacctgacttcgaacggtagtacaatgctacagtaagcaaaacagcatggttatgctcagcaaaagaaataatcagcagagtaaaaagacaacctatagagtgggagaaaatctttacaaactatgcatccaacaaagtactaatatccagaatctataaggaactcaaaaacagacatagaccagtggaacaggttacagaacgcagaaataaagccgcacacctatagccatctactcttcaacaaacttgacaaaaacaagcaatggggaaaggaatccctactcggaaattgtgctgggataactggctagccatatgcagaaaactgaaactggactccatacgtttcaccgtttacaaaaatcacctcaagatagattaaagacttaaatgtaaaacccaaaactataaaaaccctggaagatatcctaagaaataccattctggacacaggccattctggacatatcctaggaaatttcaattctggaaaacactttatgatgaagacgccaaaaacaattgcaacaaaaacaaaaattgacaaatgggatctaattaaactaaagggcttctgcacagcaaaggaaatcatcaacaaaccacctatggaatgggagaaaatatttgcaaaccatgcattcgacaaaagtctaatatccagaatccaaaaagaacttagaaaaatcaacaagcaaaaacctaacaaccccattaaatgggcaaaggagaggaccagacacttctcaaaagaagacaaacacgtagtcaacaagtatatggaaaaatattcaacatcactaacattagagaaatgcaaaacaaaactgcagtgagatacaacctcacaggaggcagaatggctattatcaaaaagtcaaaaagtaacagatgctggcgagcttggggagctactcccaggtctttggaaggctgaggcatgagaattgcttgaacctgggaggcagaggttgcagtgagctgagattgggccattgtactctagcctgggcaacagagcaagactccgtctcaaaaaaaaaaaaaaaaaaaaaacccgagagagagagagaaagaaaaacccacagccagcattatactgaatggggaaaagttgaaagcattcccccgagaactggaacaagacaaggatgcccagtttcaccacttctattcaacatagtactggaagtcctagccagagcaatcagacaagagaaagaaataaagggcatccaaatcagtaaagaggaagtcaaactgttgctattcatgattatatgatcatataatgagaaaaccctaaagactcatccaaaaagctcctagatctgataaatgaattcagtaacgtttcaggatacaaaatcaatgtacacaaatcagtagcactggtatacaccgatggtgactgagctgagaattaagtcaagatctcaaccccttttacaacagctgcaaaaacaaacaaacaaacaacaaacaaacaaacaaaaccaaagaaaaaaccccaagcaaacgaacttaggaatatacctaaccaaggaggtgaaagacttctacagtgaaaactacaaaacactgcagaaagaaatcatagatgacacaaacaaatagaaacacatcacacgctcatggataggtagaatcaatattgtgaaaatgaccatactgccaaaaacaatctacatcatcattcttccctgaactagaaaaagcaatcctaaaattaatgtggagcccaaaaatagcccgcataaccaaagcaagactaagcaaaaagaacaaatgtggatgcatcacattacttgacttcaaactatactataaggctatagtcaccaaagcagcataacactggtataaaaataggcacatagaccaatggaacagaatagagaactgagaaataaagccaaatacttaagccaactgatctttaacaaaggaaacaaaaacataaagttgggaaaggacaccctattcaacaaatggtgctgggataattggcaagccatatgtagaagaatgaaactggatcctcatctctcaccttatacaaaaatcaactcaagatggatcaaagacttaaatctaacacctgaaactataaaaattctagaaggtaacattggaaatacccttctagacatttgcttaggcaaagacttcatgaccaagaacccaagagcaaaggcaacaaaaacaaagataaatagatgggacttaattaaactaagaagcttctacacagcaaaagaaataatcagcagagtaaaaagacaacctatagagtgggagaaaatgtttacaaactatgcatccaacaaagtactaatatccagaatctataaggaactctaacaaatcagcaagaaaaaaccaaattatcctatcaaaaagtgtgctaaggacatgaatagacacttcccaaaagaagatatataaatggccaagaaacatgaaaaaatcctcaatatcactaattattagggaaatgcaaacaaaaccacaatgcaataccatctcactcctccaagaatagccataatcaaaaaaataaaaaaaaaaaatagatgttgccatgggtgtagtaaaaaggaacactttcacactgctggggggaatgtaaactagtacaaccactatggaaaagagtatgaagatttcttaaataattaaaagtagatctaccatttgatctagcaatcccaatactgggtatctacccagaggaaaagaagtcattatatgaaaaaaacacttgcacacgcatgtttattgcagcacaatttgcaattgcaaaaaatacggaactagctcaaatgcccatcaatcaatgaatgcatacagaaaatgtggtgtatatatacgtatctatgtgtatatatgtgtatgtatacacacacacacacacacacacacacacacaccatcgacagaatactactcagccataaaaaggaatgaaataatggcattcacagcaacctggaaggagtcggagaccattattctaagtgaagtaattcaggaatgaaaaaaccaaacattgtatgttctgacttataagtgggagttatgctatgaggatgcaaaagcgtaagaatgatacaatgggctttggggacttagggggaagagtaggaggagggtgagcgataaaagactacaccttgggtgcagtgtacactgctctggtgatgggtgcaccaaaatctcagaaattaccactaaaaatattttccatgtaaacaaacaccacctgttccttaaaaactaatgaaaaaagaaaaaagacatgagatcaacctaaatgcccatcaatggtgaactggataaagaaaatgtggcacataggagggggtatatctcagggttagagcatcagactgcggaccaagaaaatgtggcacatatacaccatagaataatacacagccacaagaaagaacgagatcatgtcctttggagcaacgtggatggagttgaggccattatcctaagtgaattaacacaggaacaggaaaccaaatatcccatattcttacttataagtgggagctaaacactgagtacacatggacagaaagaagggaacaatcgtcactaggtgaatttgagggtggagggtggaaggagggggagaatagaaaaactacctattgggtattatacttattacctgggtgacaaaataatctgcataccaaacccctgtgacatgcaatttatccatataacaagcctgctcatgtaccccttgagccgaaataaaaattggagaagaaaaaaactcgtaagagttgtcactttgggtagagttatgggcattatgatttgaaggcatattctaaggtcattcctcctttatttataaagttctaatttttaaaataaaagtgcatttgagtattttatcataaacattaatttaagaattcactggattttgtagtaactatgtaatggatgaactttgctatgagtgtcattggaatggataagcagagacaaaagttgatgaattaagaaatgaaaaggagttaggatctagagacagtagttacagacttattttgaggaattcaaacataagacaaatggatggtagataaagatggatggggcattggatatacggcaagagtttttgtttgcttgctttctttaaaatgggagagtttatatttatacacctatgtctatataaaatgtttctcaaatatacttatatatatacacatacatatatatgaaatgtgcaactgtacttacatacagctatgaggaagaggccattagatagattaaaacatacagatatgttataatacagatgaaaaggaataaattgatcatgtgaattttcttgatgataaacatttaggggctatgaatgtttgttaaaaaaatttcgtacaatttgggacatggctctgcttttaatcaactgctttccaaggattttaacactgaaacgaattttaatagagcttttctatacaacattctgaatattttaacagttttaatgaagcatccttaattgaatattttcataagaaaaaatgagaaagaaattaccctaatagaaatgcccattgccagggaaatttcataatgaagtgtgaaaaaacagcagctgcacttgcctccataaggcatggacctacagccaatctgaaacaaacgaccttcaaatgcctcaaagcctgaaacacaaaacagtcacacttagatacatttacaatggccaacaagaaaattattttaacaaatgtcaaactataaagtcttttttcataagaagctttcactaaacgaaatctcatttcaacagattgtcccactggactttgaactctattacattttatatgtcatcataggttggattataaacaatttcatctttttaaaaatattattatattttaattattaaaagatcaattttactgtgattaaatagctaatgctaccttcctgaactttcctaataaatagtataataatagtgtcctattagtgttttcccattaactttttgatatgaactgtttgattaacttaataagtataaatagaataccaacatgccaaagaaaataacttaaaaactgcataattcattttaaaagggagaacttttcaatgttctccttggttcatactttctgctggagaatataatcttattggctataattatttatgctcttgagctatttctattaaaccacatttgccacatttatttgagtggctgtcatattcatgaatagtcatcttcttatagatgggatttatgatccctagaatgtaatattttaagaaatgctttaaaagattggattttacaataatgcaaagataatcaggaacataatcctgtggagaaaatgtcataaaaaaattactgaaatccttaatctccctaaaaaaagaaaaagacttttataaggtttttcttatcctatgttaactgaaaagtacatacttctccatagaagagcctcccaaataatataggtgctatataagagacatttatctctgtgcaaatgattagatcgctaataaagaccttacaacacagtcaattctcttcatatcagtgataatgatggctagacatagaaattagggtgccaatatttctatacagtctttttttcttctgtttttttcttctgtttgtttgttttgttttgttttttgagacggagtctcgctctgtcccccaggctggagtgcagtggcactatctcagctcactgcaacctccgtctctcaggttcaagcaattctcttgcctcagcctcccgagtagctgggattactaggtaaatgccaccagcccggctaatttttgtagattacaggcatgagccgccatgcccggcctttttttctttatcttaggtttgtttacagactctatttggaacaggaaaataaaatttttgcttctttttctttctcaccgtcctctaatatttgaaataaccttactcgatttgtaattgtaaatctacctgtggatcgagtccaagcccagctcttattagaataatggtaagggcaatgcttcttaaaattgaagaccatgtgttaggaacatggacatgttcattgatgaatggaacattcctaatcgtaaaaccagccagtaacatcccttaaaagaaagaaaataaagatacatgacagttcatttttctgagaaagaaaacggaaatgtttactttcttttctaatgcactatgtctctcattattttggtaaagggcaggttacaagcaagtagagaaggcagcatgaataaaggaatggcgataagaaacaatacacctaaatggggttcaacaagtaagttagtgttgctggaacatacagggcaaggaaaggagggaggagaatgagcttgggtgggccagatcatagaaaggtctccccccactttggcaaagtaaggcaccatgggaaggttttaggcaggaagtaacataatgagtcttgcgttttttatgtgagggtcttggtgaattagtttgggataaaactggagacagagaccaaattgaaggctctgccacagtccacgcaaaagttggaaacaaatagcctaagctagagcaaaagagaaagtttggagaggaggaaaatgattcaataaatacttagaaggtgctgtaagaaaattgtggatacagaagggacagcagagataagatgtagagattatctctactgacagtgtactgaatatatatttatttttgaggacagggtctcattctgttgtccaaggtgagtgcagtgatgcaaacatggctcactgtaggcttaacctcctgagctcaagtgatcctcttgccttagcctcctgagtagctgagacccagaaaaatttttaatattttgtaaagacaaggtctgctatattgcccaggctggttttgaactcctgggctcaggtggtcctcctgccttggcctcccaaagtgctgggattatgggcatgagccaccgtgcctggcccactgtactgaatatttagatatatttgaatacagtaagttctcacttaacatcatcaataggttattggaaatggcaactttgagtaaaatggtatataacaaaaccaattttagcataggctaaatgatataaacaacagtcaatttcctacagcatatttccggtcacaaaacatcaccaaacttctaaataaagatccaaaacacttctagtattaaacaatgaaataaatgtgagctctacatacactttagaaagttttataaaaacaaataagataattatttacttaatttttggtgaatccatgagtgatggtggttatagcggtgatggttaaaatcaaagaataaatgtttacaaagtgaaaattgtaaggagcacctcctcccactatgcagttcaaaaacaatcacaaatatggtaggctggctgagagttttcatatcacattgtctattgtcatgcatttgtatggttaccatatacttaacaaaattttattttacaataatttgtattcattcatttattcatcgtacaatccacttattctagttcagggtcaaaggtgactgaaacttaatccaaaaaaatcaaggagggactccctccctaacacattccatgaatctagtatcacagttatacccgaatcaggcaaagccatacacacacacacacacacacacacacacacacacacacacactactggtcaatatccctgatgaacatagatgcaaaaattctgaactagcaaaatgaattcaatagtacatcaaaaagataatatagttaagtggattttactccagaaatacaaggatggttcaacatgtgaatcattcttccataaatacatatacacacatatgttcattgtagcactattcacaataaaaggacatggaatcaacttaaatgactaaataaagaaaatgtggtacatatacaccatggaatgctatgcattcataaaaaagaatgacatcatgtcctttgcagcaacatggataaagctgaacaccattatcctaagtgaaacaactcagaaacagaaaaatcaaataccacatgttctcacttatatgtgggcactaaacaatgggtacatatggacctaaagatggaaataatagacactggggagtccaaaaggagagagggttggagggttaaggttgaaaaattacctattgggtatagtattcactatttggtgatgggttcactagagcccaaatgtcaccattatgcaatatatccatgtaccaaacctgcatatgtaccccgtgaatctaaaatttttaaagattctattaaacaataaagcaacaggaataatgtactaaggatattaaatttattttaaaaataaattttggataaaacttgtgtgtatatatgtagacagagaaataaatgcatctataaaggagctgtacacacacacacacatacagtaaatacatacatgaagaaactatataaaacatactacattgaaatatttctgaattataactaattcaacaagaaaatgttcaacatttgcatatagtcaataataaagaaaagagagctaattatatacttaccaagaagaggtggaagtggaggcactaaaggtattctaatgagttgtaaaatttttcccccaataatggcactataaaaaataatgaacaacccaaataaatttccaccagggagagcttcagagcctaagattgaccaggtcatacaccatatcacaaacagtataactcctgaaatacaaaaaagtgtacagctatatatctacatacacatagatgtatacaaacaaaggatcaattctcttttatcatatatactaatagccagttttataaaatgatacatggtatagatcaacattgcttactagtttggtgaaagagatatctgcttaacatatattccaaataacctgtcaatttatgaagtaggtttcaaacaaagtgtttttactttaaaaatatttaaaacctatatgtgggccaggtgcagtggctcacaccttaatcccagcactttgggaggctgaggcaggctggatcacatgaggttcaggagtttgaggccagcctggccaacacagtgaaatcccgtctctactaaaaatacaaaaattagccaggcgtggtggtgcgtgcctgtaatcccagctacatgggaggctgggtcaggagaattgcttgaacccgggaggtggaggttgcagtgagccaagattgtgccactgcattccagcctgtgtgacagagtgagactcagtctcaataaaaaaataaaaaaataaaaaaaacctatatgtgaactctggaaaatgctaaccattataatatatgatagttaaaaacatcatggcaatatgatgagatttacttcattttatattttaaaatagctttttcatcaggatggaaaataagaggatgactggctgtgataagaattcacaaccttattgaagatcacagtgtcaaggtgccaaatcttttaagaggaacctactaaatctttgtattgaaaggataattcaactgatatttggcataaatgtattagaggaggtaatggctggaagaaatgaacctagattttgtgggaataaatataaagtatcttagattatgtgtaggaagtagaggtagataagatgagtaggtataagttactagacatcttgtttctggcaactaggtgctactcactgaggaatccataggtttctataaaggacagacaataacatggtaaatttccatatgctaattaaattgctacctttatttgctatgaatcataattgctaatgcttttaatattcttaaaacagtttatatgcattttttagctatgacccctttccggctgtatagaatttgccagggtaaaagaggacgattttgactcactccaggcagaaagttagaacaaagtatctctttcctcctcccctctgattattgtcatcctgcaaaactggaagccttggagggctaaactcttactaaaagaatggaccaggctgggcatggtggctcatgcctgtaatcccagcactttgggaggctgaggcaggtggatcacctgagctcaggagttcaaaatgagcctgaccaacatggtgaaacgctgtctctattaaaaatacaaacaattagcctggcctgttggcgcatgcctataatcccagctacttgggaggctgaggtaggagaattgcttaaacccaggaggcagacattgcagtgagctgggatggcgccacttcactccagcctaggtaacaagagcaaaactccatctcaagaaaacaaaacaaaacaaaacagaaaacaaaacaaaacaaaacacggacaagaaaatgtcatcctactgacaaattgagaagacaaggcagtttgtcttagctggtctctgggtggcaaagtcttttttgagaattcataggtaaaactggcctcatccaacttatgtgtagggctcaaattacattatgtgcacaggttagggatcccaaagttctaaacctaccataaaagtgtccctgcatagaagtatccctagaacacacttagtagatgctaattcaaaaaatctctaatagacagtcctgatcccagactgcataaagtctcaaaggtaaagccaagtgaatctgaacttaaaataagaagaaatatcccatgagcaaaagttaacagatactacaaagaatgggattagatgtctgaaaaccttagctaatagaaccactagatagacactataaaatatgtattttcaaagggactagagacaatttttaaaaattggagacatgagaagaagaaattacttgaaagcattgtaaaataattaaatagaacatctagaaaaaactgtaaaatttactcaactaaaaaaaaaaccactaagtacccaaacagcagtctagacatggctgaagagagaacacagcaaagtagtagatatgaggaaattacttaagagcatagcacacacacacaaaaaaatgaggtggaaaatgagagatttagattatggaaaagatctaaaacacaactaatagtagtttcagaaacataattgaaagaatgaagaagatataatatttgagaagaaaactggcttcaaactttacagaattgattagggtttttattgatttggacacaggaagtcaaatgagttctaatcaggattaagtaaaaatagatacttagataaaatgttgagaaactatagactaccaaaggcaaaaataaaatcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatgatatctcatagtggttttgatttgcatttctctgatggccagtgatgatgagcatttcttcatgtgtttttttggctgcataaatgtcttcttttgagaagtgtctgttcatgtccttcgcccactttttgatggggttgtttgtttttttcttgtaaatttgtttgagttcattgtagattctggatattagtcctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgatttcgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgctggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctcaggcaaaaataaaatcttaaagaatctagacagagaaaaagagattaatcataatcgaataaacaatagagcagattctcagtacttatcagcaacaatagaagatggaagataaataaagtcttcaaagtacagagataaagaaatcattcaatgttgaattctgtagccagttaactgtcactcaaacaaaagacaaatgaaagatattgtcaaacaaatacatttaagaacatatgccattttttaccagggaaaaatctactgaaagatatgctttagaaatatgacatagaaccaaaaaggaaggaacaatgtgcaaagaaattggtaaaatgtaggttagtctaaacaagtactggttgtgtaacacattactaatgaaaattgttaatcagaggatataaagataaggttgggaggtgacatgaaaaggttggcaatttatttccacaccaaaactccccccaaaaattgcaaaaataccaaaaacaaacatttcaggaccctgaaaactcatcaaaggcagttatcaaattaagaagcatttatccttgaaaaaagtgttagggttttgggtaggattggtaaaagtctgagcccttcctgactggggttgctccctgatatggtttggctttgtgtccccatccaaatctcatcttgaattgtactcccacaattcccacgtgttgtgggagataattgaatcatgggggtggttccccccatactgttctcgtggtagtgaataagtctcacaagatctgatggctttatcaggggtttctgcttttgcatcttcctcattttctcttgccgccaccatgtaagaagtgcctttcacctcccgacatgattctgaggcctccccagccatctggaactataagtccaattaaacctctttttcttcccagtcttgggtatgtctttatcagcagaatgaaaacggactaatacactctcatctctcttctcatccccaagctcagctgggaaaaacagtagttttaccagtttgaagctggatgtaaaacccagcagctttcctgttagggctgggggcaggggtggatttggtatggagtagagggaagaaatcaatggttttgccagttaaatatagcagagtggtttgagaatgaacagacagaattgcagctttgctagtctgaggttgcagtttcaattggggaagtggaagacaagacaaaaatttaaatgagagatcctgagggtcaataggtgcagcaaaccaccatggcacatgtatacctgtgtaacaaagctgcacgttctgcacatgtatcctggaactcaaagtaaaattaaaaaagaaagaaagagagagagagaaacaacaaacaaagtggaagaaagaaagagagagagaaagaaagaaagaaagaaagaaagaaagaaagaaagaaagaaagaaagaaagaaagagagagaaagacccacatgcaaggctagagttttccagttccaagttccaattctctcactgagaagagtggctcacggtgcctaaactgtttatacaaacaatatggtttactctgaacagctgcttttcttctgggagtctggaattctggtacatgtgaaggacagtaacctccgtaaaatcctgagtactgagtctctaatgagactctggtcctggtagacgacattgcacatgtgctgtcaaaatttcatgctggggaagagaaacacatccttgtaactccacaggagatgattccaggaagtttgtgcctggtatcctccagactttaccacacacaactttttccctttgctaattttgctttgtatccattcactataataaattaaaaacctgagtattactaaaaaaaaaaaaaaaagactgatcctggaaaggagagaataatagaaagtttgtgataagttctccacacatatatggccgattggaaaagtatggaagtgcaggaaagactcaagagagtatgacaaaaagtaaaaatgaagtaagacttgagtattaattgcaactttgaatgcattcacccacccacccacagattatttggcagacagtggaagccttactagctttaacataatgtctctccaaaatcaagctatgcaacagacacaaaggaaatccctagaaagacaggctaaaacaacaataacaacaacaacacaatataaaagacatcactgctgaaaaccactgggcagaaggattacacagcacatgtataggccaattaccaaaacaataacaacaacaaaaacaatcacaaataaaaaccaaatccagatttgctataatgtgtaattaaagtgtttagttttcaattaaaaattatcagacatgtaaggaaacaggaaaatatggttcatactctggaaaaaaagcagtgaatagaaactctcaattcagatactggatttagaaagaaagttttcaaagtatatattataaatatgttcaaattaaaaatatgataatgtgctgtctaatagagaacatgaataaggagacagaatatatttaaaaatagaatctagaatcgaaaagtacaacagttaaagtgaaaaaatcactagcgaggttcagtagcatatttgaccttgtgaaagaaagtatcagtgaacttgaagatagaccaatagaggttaatcaatctgaagaacaaaaagaaaaaagaacgaagaataataaacagatcctcagaaacttatgggataccatcaagagcactaacatatgcataatgggaattccaggagaagagagagataagagggcagaaaaatatttgaaaacataatgtctgaaaacttcaaaaatgttatgaaaaacattaatcttcaaatataagaagttcaacaaatctcaagtaggataaacacaaagagattcacacctagagccatcatagtcaaattggtgaaaaccaaggataataagaaaatcatgaaaatagcaagagatgacttatcacatacaggggaacaataatatgatcaatactggcatttttatctgaaaaaaatggaggccttatgaagcgacatttcaaaagtggagggaaaaataactgtcaattaagaattcggtatccagttaaatgatccttcaaaaatggagctgaaataaagacatttccagataaataaaaataaagagaacttatccttgctaaagaaacactaaataaaatgcttttaagataaaaggatatgacaccagatggcaacttgaacctataaggaataaacggcactggaagtggtaaataaatttgtaagtataaaagattgtatgtgtgtatgtgtgtatatgtgtgtgtgtgtgtgtgtgtgtattctgatttcatctcttttttaaaaaaagcatctgattattataggcaataactataacaatactgctgagttcatagcatataagaggtacattggatcaaagttgctatataacactggaattaagtaaaaattattaaaccaaagtagattgtaaaaagtgaagatgattgattattataacccccaaaggtacttgggaggctgagatagaagtattgcttgaggctaggagtttgagactagcctaagtaacacaatgaaactctgttgatatagtttggatatgtgtccctgcccaaatctcatgttgaattgtaatccccaatgttggagataggtcctgctgggaggtgaatggatcatgggggcagatttctcctgaatggttagtaccatcctcttggtgctgtccttgggacagtgagtaaattcttgtgagatctcgtcatttaaaagtgtgtggcactgccccttgctcttttactcctgctttcgctatgtgacatgtctttgccttctgccatgattgtaagcttcctgaagccttcccagaagcagatgcctgcatgcttcctgtacagcctgaagaactgtgaggcaattaaaccacttataaattatcgagtctcaggtatttgaaagcaatgcaagaatggactaatacacctgtctctaaaaaatttaagcaaaattacccaggtgtgatgacacatgcctgtagtcccagctacttgacaggcaaaggtgagaggactgattgagcccaggagtttgaggctgcaataagctatgaccatgccattgtctcttaaaaaagtaagccccagagaggccaggcgcagtggctcatacctgtaatcccagcactttgggaggccgtggtgggcggatcacaaggtcaggagatggagaccatcctggctaacatggtgaaaccccgtgtctactaaaaatacaaaaaaattagccgggcatggtggcaggcacctgtagtcccagctacttgggaggctgaggcaggagaatggcgtgaactcgggaggtggagcttgcagtgagccgagatcccaccactgcactccagcctgggtgacagaacgagactccgtctcaagaaaaaaaaaaatcaacagagaaattgaaatagggcactaaaaatacttggttaacatgaaagaagcagtaatgtaagaaaagaaaaacaaaaagacatgacacatagaaaacaaataacaaaatgttaaatgcaagtccaaccatatcaataattatgtgaatggactaaaataaaaaggcaactattactgtacaggactttaaaaaaacaagattcagctatatggtgcctacaagaaacaaactttagataaaacaagcaggttgaatgtaaaaggataggagattaggagacatacatatatatatacacacacacacacacacacacatacgcaaatggtaattatggggaaagaagaaaacataagtgtaattactatatatatgtaatttttttaacctgtaagtcagttttattatctgtaaaatggggataaaaaaattatctcctgccaacataaataggttttgttacaataaaatgaactagtgagcatgaaagaacattgcaatctgttaagatgttcttccaggaattcttgcattctaggaaaatcagaacatttctggttatagaatttttgacattttgaggaaagatattttttaggatatatgtgaaaagaacactttatcttctctaattacatcatggattctctttttgcattgagattttgcttgaatatcaatagacaagacaagggagtggttcaggcacttgtctagtgagcggatcgctgacaggaagcaaggagccagaaggacactcccctgtgctgttggtcaggggcccgcttggctggtgccaaggatttgttctcagtgacaagacaaatacagaaatggagagtggttacaaacttctatagcaatttgacactgtattttataaaaagtaaatatcagtctacatcaaataggaaattaaaaacaaaaacaattgggtattaatctactaagcttagtccctaggtgacaaaataatctgtgcaacaaatccacatgacacaagtttacctatgttacaaacctgaacatgcacccctgaacccaaaataaaagtttttttttttaaaagaaaaacaaaacaaaaaaaccacatctgtttcttcatcacagataatttgagaagcactagtgtcaggaaaaaagaataataaataatatgtacattaaaactcaccagaaaacatatatgcactgggatatctttttggacattaaagaaatgtgaaaaatcacacatatattcctaatgaacttgactatattatatatatatgtttatttagaagtattaaattgaattaagtattaaatttattttttaataagtggtataaaggaaggatgttctgattaagaaggataggtaaagggcaattacaactctgggtagagaaatagtaaaatggccagaaacagactggcaaaggctatggagtaattaatctcacaaaaggaagcagaatttattaatataaataacatagtattgctgatacttaaataattgtgagttatattgaagaattattttatattttaaaatagcaaaaccccccaaaaaacagtgtggtaaagctgtggtgaggtttgtacattttaggaagccttgttatttttagctcatatggttttttgataagtaaaaatttaaaaaaagttaaaaatgatttctctgctgcttaaattccgatacacatctattgagtggtaagatatgagtttagagtcactgtatttttttagtagttctactaataagaaattttcattaagctttactttctttctttctttctttttttttttttgagatggagttttgctcttgttgcccaggctggagtgcaatggcatgatctcggctcaccacaacctccgcctcccgggttcaagcgattctcctgcctcagcctcccgagtagctgggattacaggcatgcagcaccatacccggctaatttggtatttttagtagagacagggtttctccatgttggtcaggctgctcttgaactcccgacctcaggtgatccgcccgcctcagcctcccaaagtgctgggattacaggcatgagccaccgtgactggcctaagctttactttctaaaaattatatcaaaattggtatttctctattatgtaatcataaattatatcaaatatgctgttttgaattttatttttccctttaaacataaagacacacattcagttcattgtgctatataaattaccagtgtgatcacaaattaagaaatgcaattcaaagaattttgcgtacaaggagtcctgaaagtgttaataacttttgatgcaaagataattttatgaaagtaatagaagactaaaaaaaggtacaaaacaattattatgtaagtatcttcctttttctgaatcacccatgattactttttccaccaagcaaaaactgactacatacttcagatctgtctcaaatctccccagcctcttttcctaaacctccccagcctctcaggacagacaggctgctcctgtactttgtgcattctgctatttttagcaagaggcctattttgtcagtgttgtctgaatagtatttgccaactcccagactttcagtcacttatttgtttatttatttatttatttggctcttttcttgtatttcccttttccttttctttcctttctttttccatttcctcctcccttcctttgcttacttatttttttccctttaattcccattcactatttccatgactgtcaaatagtaggttgatcctttaaaatattccttttttaaaatttattgtactttaagttctgggatacatgtgcagaacgtgcaggtttgttacataggtatacatgtgccatgtggtttgctgcacccatctacaatatatcttaaaatgaataaaagtggaaacacgcagaagacatggtgtatggggtgagtgggttgccaagtggatggtggcagggtgctccagggtggccagtggggctaaatgctgtgtattccaagcatggcggggttcctgccttcctgtgtggcagactgtggcatcaggtaagagccacttggtgcccaccctggctcctccattgccttgctctcagcccctggcatccagcccacacctggaggttgagctgcacccactgctctgggtctcagccctgtgatcacctcagtagatattctgagcttggctatgcaggcaacactgagccatagtttactattctttcttgcatttctatcagagagtcagcaaaggtagttgacaaagcccaaaggagaatgttgaggggagttgatgaccttgactttttcatacaggatgaagccattgataaatctatgtatgctacaaagtggtcaatatgactggaatcactgaagactgggatattatggaaaggttcatggagcaagtggtttttaaatatctttgagcagaatctgaggaccattattttttaatgacagaacttccactgaatacactagaaaatacagagcatttttgcagaaattatgtttgaattatttaatgtaccaggattctacattgcagttcaggaggtactggccttggcagtatcttggacatctcaacaagtgggtgaatgtatgttaatgagtatagtcattgacaaaggagatggagtcacccatgttctcccagttgtagaaggttatgtaattgggagctgcatcaatcacatcctgattgtaggtgatactgtgtatttcactcaacagctgctaagggagagggaggtaggaatccctcttgagcagtcactggagaccacaaaagccattaaggagaaatactgttacatttgccctgatacagtcaaggaatttgctaagcatgatgtggattcctggaagtggatcaaacaatacacaggtatcaatgtgatcaaccaggagaagttcataatagatgttggttacaaaaggttcctgcaacctgaaatatttttttacccagagtttgccaacccagactttatggaatccatcttgaatgttgttgatgaatacaaaactgtcccattgatgtgcatggtccactgtataagaatgttgttctttcaaggggtttgaccatattcggggatttgaacctcaactacagagagatttgaagagtggtacatgccagattaaaactcagtaaggagctcagtggcaggagaatcaaacctaagtttgcagaggttcaggtggtaatccatcacatgcaccacaatgccttatggtttggaagcttaatgatagcctcaactctggagttatttcaggcctgtcacaccaagaaggactatgaagaatatggccccagcatctgccaccacagccttctctttggagtaatgtcttagtgtctgccttgaaagcatcatttaatagtgtcatgttggggaacaagtgtccttcagaacccagagaagactaccatttctaaatgacatttggtgttgatgtctgagcagcatgcttgcatcacctagtgcatgaggcacagggcagagtcatttcagtaaaagccatttctttatgtgttgactgttgtatgcccactccttcttctctcactccctttcttcatgcttccccagtttccctcctccttttcacttgagcttttttgttgacaaataccattctgaaggaatttaaatgtgactttgaaaattgttaagaggaaaaaaaatttcaaaaatggcccaaaatagttctcccccaggaaataatgcagtggtataaatccttttcccccagcctatttttataaataaaatgttataaacttaaaatacaaaaaaccaataacataacattatttacaggatgcaattaaagcagtgtatagaggaaaatgtatagctttaaaaacagaaagaaaaaataatctaaaattggtaattaaaacttccatcttaagactctagaaaaagatgagtaaaccaagccaaaagtaagtaggatgtatgaaataaaaaggtcacagtggaaaacgataaatacagaacaggataacattaaaaacaaccaaagaaactcaaaattgcttatttcggaaagtcaagaagataaataatatttagttacattgaccaagaaaaaagaaagaagacactaattcccaaaatcaagaatcaaagaaaaatatcatcacagaccctacccttaaaaggatgttaagaaaatagcataataactttaaggcaaaaaattcgacaacttagataaaatagaacaattcctagaaagacacaaattaccaaaactgactcaaggaaaaaggaaaaaaaaaacaaatatcaatatcaagtaaagaaattgcatcagtaatttcaaatcttcctatagagaaaaaatatacttcactggtgaactctatccaactattaagggaggaaataataccaatgttacaaaaactttattaagcaaatagatgaggaaggaaacttcccaatgaactttatttcatttgatatcaatattaccctgatatcaaaacaagacaaagacattacaagaaaacacagctatataccaatatcccttatgaacctagacataaatattcttaaccaaatattagtaaatgtaattgagcaacatatgaaaaggattttataccataatcaaatgaagtttatctcaggaatgtgaggtggttgacttaacatccaaaaatcaatgtaataaactatattaacagaataaaggacaaaaccatatgatcacctcaatagatgcagaaaagcatttgacagaattcaacactcatatatttaaaaaaatctcatcagcttatgaatagaagggaacttcttcaaatgatcaaggcatctaccagaagcctacagccaacatacttaatggtaaaaatgtgcttacctctagattaggaaacatgcaaagatatctgtgtttaccacttctattttttccttgcaatagtcaaggaaaaaagttatggaaaaaagacaactctttttattgttagccttgtatacagaaaatcctaaggaacacacccacacacacacacccacataccacaccccctcccagacttactagaactaagagggtggcttagcaagtttgtagagtatatgatcaatatacaaaaatcggttatatatatagtagcaacaaacagtacaaagatgaaataaagaaaacaattccaatcacaatagcatcaaaaataaatgtcttagtttgttttatgttgttataatagaatacctgagactgtataaagaggtttatttagctcatgtttctccagaccgggaagttcaagaagcatggcaccagtatctgcttagcttctggtgagggctttagtagtgcatcacaacatggcagaagaccaaagaggaagtgggaatgtgccaagaggccaaacacaaggtacaaccttgtacaatgggttgctttataacaatccattctcagggtaactaatctattcccacaggaaccaatccagtttcatgagagcaagaactcactcactatatgaggactgcaccaagctgctcaaaatggcagagcccccatgacccaagcatctcccattaggccctgcctcttaaaggttccaacatgatttttggcagagacacggaaaccatggcattccacccttggaaccccaaactcatgtccctcttacactataaaatgtaattattcaatctcaatggtccccaaagtcttaatgtattccagtaacaattcaaaggtcaaagtccaaagtctcatataagactcaaggcaagttcctcctagctatgagcctgtaaaataataaaaaaaaaaacaacaagttatttacttccaagatacaatggtggaatagtcatatggcagacagtcccattccaaaagggagaaataggccaaaagaagaaagaggtgacaggcctcgagcaagttcaaaagtcagcagggcagacactaaatcttaaaactccagaataattctccactccacgtgctacctcctgggcacagtggggagtttttatccctaaagccttgggcagccccacctccattgctttgttgggcatagccacatggctgctctcactggttggaattggatacctatggcttttccaggctgaggttgtatggtggcaatggctctatagttctggagtcccagtggtggtccacttcatggattcactaggtattgccctggtacagactctttgtggcagctccaaccctacatttctgctcagcattgccctagggaagatacactgcagtggctctggccctgcaacaaatctccacctgagctcccagtcttttcagtacattccttaaaatctaggtggaagccaccatgactacacttctcttgtattctgcacatctgcaaaactagtaccacatggttgtaaacgccatcaaggcttaccacttgcaccctccagagtgctgtcatgagctgtacctgaggctgcttgatccacgactgcgtgccaccaaggtttatggtttgtatcttgtggaatggcagcctgagccatacctgggtatgattgtgccatggctggggtggctgctgagggctgtgccagaatttggggagcaggatctcaaaacagcacagggcagtgatgcatggattctgtctcttaaaaccattccgtcctcctagacctctggaaaggcaacctcaaaaatttctgaaatgtcttcagggcctttaaaaaattgtctcaataattatcaactggctctcttctctcagtgctaatctctttagtattggttgttctgctgcacccttggattcctctcctgaaaatgctctttcattctctaccacatggccaggctattaattttcaaatttttatgcttgcttcccttgtcattttgcatttcactgaatgtagtaagaagtaactacatagctgctctatattttgcttagaaatttcttctgccaggtaccctagttcatcactcttaagtttggccttccacaaaaccttagggcacaaagccttagaaacaacacagccaaatttttgctatggtctaacaaggatgacttggtctccagttcctaataccttgttcctcatttctatctgagatctcattagaatggcctttgctgtccatatttttatcagcattgtggtaatgactacttaaccaatctctaagaaattctaaactttctctcgtctttttgttgtcttctgagccctcattgaaattatccttaatgctctgtttatggcaatacagtctttttctagtctgctccttcaaacttgtccaacttctgcccattacccagttccaatgatgcttctgcatttttgagtatctaaatagcaacatcccactctcagtacaaattttctgtcttagtccgttttgtgttgctataacagaataccggagactgagtaatttataaagaggtatatttggcttgcagttctgcaggctggaaagaatgacactggcatctgcttgggttctggtgaaagctttagtgttgtatcacaatatggtagaacaaggtcaaaggggagtaggcatgtaccaggaggccaagcatgaagcgtgacctcaccgtatagcaactcattctcatggtaactaatccattcctgagacaactaatcccacaagagtgagaactcactcaccagtgtaagaatagtaccaagctgcccacaaaagaaaagctcccaagacccaaacacttcccattaggccccacctcttaagcattccaacatgagttttggtaaagacactcaaactatagcaataataattaggaataaatttaacaaaataagtgcaaaacctttgcactgaaaactaaaaaacatcactcagataaatgcctaaataaatggagagatatatcatgttaatggattagatgactcaatattgttagatgtcaattgatctacaaattaactgcaattcctgccaagagtctagaaagattattggaaaaattgacaagctgattctaaaattatatagaaatacaaaaatacctagaatagccaaaaaaatcttgctaagtaagaatgaagttagagtacttaatactgtcttatttgaaaattcagtgtaaagcagcagtagtcaagacagtgtagaatccacattaagagagatagatagatcaatggaactaagtggagttcagaatccaacccacataaatagtcaattgattttcatcaaagatgctaagacaattcaataggaaaaagatgttctttcaacaaatgattctataataactggttattcatttacaaaaactaaacctagatccttaggtcatatgcaaaaattaactaaaatggatcacagacctaattgtatgagctaaaactataaaacttctaggaaaaaaatataggagaaaatatttatgaccttggactaagcaaaggtttcttagatataatatcaaaaacatattccataaaagaaaaactggtaaattggacttcatcaaaatgatgaaatctttgcttttcaaatatttcttaaataaatgaaaggagaggattgttccaagatggccgaataggaacagctcctgtctgcagctctcagcacaactgacgtagaagacaggtgatttctgcatttccaactgaggtacctggttcatctcactgggactggttggacagtgggtgcagcccacagagggtgagctgaagcagggcagggcatcgcctcatccgggaagcagcacaaggggtcgggggatttccctttcttagccaagggaagccgtgacagacggtacctggaaaatctggacactcccaccctaatactatgcttttccaatggtcttagcaaacggcacaccaggagattatatcccctgcctggctcggtgggtcccacgcccacagagccttgcttactgctagcgcagcagtccgagatggaattgcaaggtggtagcctgggctgggggaggggcgtccaccattgctgaggcttgagtaggtaagcaaagcagctgggaagctcgaactgggtggagctcactgcagctcaacgaggcctggcagcctctgtagacgccacctctgggggcagggtatagctgaataaaagccagcagaaacttctgcagacttaaacgtccctgtctgacagctctgaagagagcagtggttctccaccatggagtctgaactctgagaatgggcagagctcctggtagggactgactgacacctcatatagccgggtgtccctctgatatgaagcttccagaggaaggatcaggcagcaatatttgctgttctgcagcctccaatggtgacacccaggcaaacagggtctggagtggacctccagcaaactccaacagacctgcagctgagggtactgattgttagaaggaaaactaacaaacagaaaggaacagcatcaacaaaaaggacatccacaccaaaaccccatctgtaggtcaccatcatcaaagaccaaaggtagataaaaccacaaagatggggggaaacaagagcagacaagctgaaaattcaaaaaaccagagtgcctcttctcctccaaaggatcggagctcctcgccagcaatggaacaaagctggatggagaatgactttgacgagttgacagaagtaggctttagaaggtcagtaataacaaacttctccgagccaaaggaggatgttcgaacccattgcaaggaagctaaaaaccttgaacaacgattagatgaatggctaactagaataaacaacatagagaagacctttaatgacctgatggagctgaaaaccatggcatgagaactacatgacgcatacacaagcttccatagctgattcgatcaagtggaagaaagggtatcagtgatggaaaatcaaatgaatgaaatgaagtgagaagggaagtttagagaaaaagagtaaaaaaaaacgaacaaagcctccaagaaatacgggactatgtgaaaagaccaaatctaagtttgattggtgtacttgaaagtgatggggagaatggaaccaagttggaaaacactcttcaggatattattcaggagaacttccccaacctagcaaggcaggccaacattcaaattcaggaaatacagaaaacatcacaaagatactcctcgagaagagcaaccccaagacacataattgtcagattcaccaaggttgaaatgaagggaaaaatgttaagggcagccagagagaaaggtcgggttagccacaaagggaagcacatcagactaacagaagatctcttggcagaaaccctacaagccagaagagagtgggtgccaatattcaatattcttaaagaaaagaattttcaactcagaatttcatatccagtcaaactaagcttcataagtgaaggagaaataaaatcctttacagacaagcaaatgctgagagattttgttaccaccaggcctgccttacaagagctcctgaaggaagcactaaacatggaaagtaataaccagtaccagccacacaaaaacatgccaaattataaagaccatcgatcctaggaagaaactgcatgaactaacgagcaaaataaccagctaacatcataatgacaggatcaaattcacacataacaatattaaccttaaatgtaaatgggctaaatgccccaattaaaagacacagactggcaaactggataaagagtcaagacccatcagtgtgctgtattcaggagacccatctcacatgcagagacacacataggctcaaaataaagggatagaggaatatctaccaagaaaatgaaaagcaaaaaatagcaggggttgcaatcctagtctctgataaagcagactttaaaccaacaaagatcaaaagagacaaagaaggccattatatagtggtaaagggatcaatgcaacaagaagatctaactatcctaactatatatgcacccaatacaggagcacccagattcataaagcaagtccttagagacctacaaagagacctagacatccacacaataataatgagagactttaacaccccactgtcaatattagacagatcaatgagacagaaggttaacaaggatttccaggacttgaactcagctctgcaacaagcagacctaatagacatctacagaaccctccaccctaaatcaacagaatgtacattcttctcagcaccacatctcacttattccaaaattgaccacctagtttgaagtaaagcactcctcagcaaatgtaaaagaacagaaatcacaacaaactgtctcccagaccacagtgcaatcaaattagaactcaggaataagaaactcactcaaaaccacagaaatacatggaaattgaacaacctgctcctgaatgactattgggtaaataatgaaatgaaggcagaaataaagatgttctttgaaaccaacgagaacaaagacacaacatatcagaatctctgggacatatttaaagcagtgtgtagagggaaatttatagcactaaataaccacaagagaaaacaggaaagatctaaaatcgacaccctaacatcacaatgaaaagaactagagaagcaagagcacacaaattcaaaatctagcagaaggcaagaaataactaagatcagagcagaactgaaggagatagagacataaaaaacccttcaaaaaatcaatgcatccaggagctgtttttttgaaaagatcaacaaaattgatagaccactagcaaaactaataaagaagaaaagagagaagaatcaaatagatgcaataaaaaatgataaaggggatatcaccactgatcccatggaaatacaaactaccatcagagaatactataaacccctctacacaaataaactagaaaatctagaagaaatggataaattgctggagaaatacaccctcctgagactaaaccaggaagaagttgaatccctgaatagacccattaacaggctctgaaattgaggcaataattaattagcctaccaacaaaaaaaagtccaggaccagatggattcacagctgaattctaccagaggtacaaagaggagctggtaccattccttctgaaactattccaatcaatataaaaacagggaatcctccctaccacattttatgaggccagcatcatcctgataccaaagcctggcagagacacaacaaaaaaaagaattttagaccaatatccctgatgaacatcaatgcaaaaatcctcaataaaatacaggcaaaccgaatccagcagcacatcaaagagcttaaccaccactatcaagtcggcttcatccctgggatgcaagcctgggtcaatatacacaaatcaataaacgtaatccatcacacttcagccttcgagtagctgacaggtgtgccaccatgcccagctaatttttgtatttttagtagagatggggtttcaccatgttgcctaggttagtcttgaactcctgggctcaggtgatctgctcgcctcggcctcccaaagtgctaggattacaggtgtgagccactgtgcctggccaatctatgtaacttttcatggaaggcaaaactataaaaaaagcagatcatttgttacttgggacttgggtaggtgggagggaggatttaatgcaaataagcatgaggaaactttttgagattatgtaagtattcaaaaactgaatttttgtaattgttgtacaactctataaatttaccaaaactcatcaaaatgtgcatttaaaataaataaattttgtggtctgtatattatacctcaaaaaagctgataaaatataaattggaacaaaagtactggaaaaccataagttggagacaaatgagggtgatcaaaattaatgcatccttcaagatgaaacgtgattttaattttaaaattaattttttaattacttgttaattcaagtacacatattaaatttcaagggtaatcgtgaatagaatagaactagaacatacaacttttaaacaaatagaggggaaaaaccttgatcaatctaacagaatgcattggggaaaagtattagagaaataatatggttaacagaaagcacaaaacatgatgacagaaataaatataaatttatcaataaccacaataaacttaaatggtctaaattagttaaagacagacacttgaagactggattaaaaacatgaaaatccaggtatcacctgtaatagttaaaaacatgaagacacaaaattctgaaggtatgagaagagtaaatgataaataaaacaaatattaaccaatatatggctggtatagctattttcatatcaaaaactataagacaaaaaacattctgaggaataaaagtcattatgtaaagacatctatgcaagtaacaattcaaccttaaaatatatgaagcacaaattgacagaattacaaagaaaaatggctaaatcctcaaccttgaagaaacttaaacctctgagtcaatgaaaatcaaaatgtagtaagattatctcagattttaaccaccgtattaaaaaagcttaatttaaaggaaatatatagacttccatatgctcaaattagagaatatatatactttgaagcctgataaagtcttaggagaactgaacctatactagcctatgaatcaaatcacaacaaataaacaaacattataacatgtggcttatactctgtaactaaaatgcaatttataatagaaaaaaatgtaaatttctttcattttcaaactaaaggcataccttaaataatttttcagtcaaagaagacatgaaaacaaaaatcagaagatatttggaagtgaaatactacataacaaaacttgtgagatagagctgaggcagtactgaaagggtaatttatatctttaaatgtttatattgaaaaatagggtgaaaattagttaagcgtccaccttcggaagtttggaaagagaaaaagagattgggcatggtggctcaggcctgtaatcccagcactttgggaggtcaaggcgggcggattacctgaggtcgggagttcaagaccagcttggccaacatggtgaaacccccatctctactgaaaatacaaaaattagctgggtgtggtggcaggtgcctataatcccagctactcaggaggctgaggcagaagaattgcttgagctggggaggcagaggttgcagtgagccgagattgggccactgcattccagcctgggcaacagagcaagactctgtctaaaattgaaaaaaaaaaaaaaaaaaaaaaaatcggagtaaacctaaataaaataaattaaaggaaataaggcaaaaagtagaaatagacattaataaactataaaacaaaaaaacaataggcaagattcacaaaaccaaatgctgattctttgaaaagaataataaaatagacacacttctggtaagattgattaattaaaaagagaaggcataaataagcaatattaggaataaaaaatgaaatgtaacataaaatatgagtgaaaaaataaagtgaatactataaatgactatatgacaacagtctaaaaacataagtgaaatgaacaacttcgttggctactataacttataaacacttagtcaagaagaaatgggacacctgaatattcctgtatctatttttaaaaattcaatcagtaaatactttctcagaaaacacccactagtatgagatactttaatatgaaagttctaccaaacattcaaagaacatataaataaccactatcacatcaaaataatttcagagaatggaaaaagagggaacaccttcaattcattttgtgaggctaacataaatgcaatataaatatttaagatcattataatccaagaaaattggaggccaaactaagcttagatacaaacatctaaaataaaataatagtaaatctagtaatgtattctaaaaaaattctggacccgttgggtacctcaggaatagaagcaaacatttaacagtttgcccaagcagcttttattttattttattatttttaaagagacagggtcttgccctgctgcctgggttggaatattggcatgatcatatagctcacagcatccttgaactcctgggctccagggaccctctgccttagcctcctgagtagctgggactacaggcacacaccacaatgcctagctaattttaaaaaagtttttattttgtagagatgaagtctcactatgttgcccaggctagcctcaaactcttggcttcaaatgattcttccaccttggtgccccaaagtgttgggattacaggcatcagccacggcacctggcctgagcaggttttaataagtcaccccatgtttggagaatttctaacattattaatattactttcccagtgtagaagccaggaactcaagtttttaaacttcctttgtcatgaaggcatagacacatgatgaacacactgctactgacattaatttctgcttttatctgaatagttggtacctccaggaaaaggaggggaatgaggttggaaaatagtacacaggaagcttcaactatatctataatgattatatatacatatatatatatatatatatatttttttttttttttttttttttgaggctggagtgcagtggtgcaatatcggctcactgcaacctccgcctcctggggatcaagcgattctcctgcctcagcctcttgagtagctgggactacaggtgcatgccatgatgtctggctaattttgtattttttagtagagatggggtttcaccatgttggccaggctggtttgaactcccaacctcaggtgatctgcccgcctcagcccccaaagtgctgggattacaggtgtgaactaccacgcctggccagataatgtttaaattagaaggtcacatgcataaatatgatatcttggacattgatgagaccacatagaaaaactatataaaaagaaaagaggaaaaggcccaggtctaagtcctgagtgatatttggtatttagaagttaggaaaagaagaatggaatatggaagacaagaaaggaagaagcagtgagggaagaagaaaaccagttggtgcctcagaattagaaaaaaaagacaagtgtttcaataagagagtgatcattggtgtcaaaagctggaaagatcttgaatacgatgcagacagaaacgttcactggatttggttaatacacttagtcagataaaccccagcaatttcaccagttacggtcgttttcatactccagagatgaaggataacatttactagcctacgtaatattctaggtcttgaatgtagatatcagtattgatttactttgaacttctactttaaaatcaagaaattaagtctcttctgaaattcaaagatattatcatttcttaacagtcatcaatagttttcatgacatctcatttgaagcaataactaatttatattgcattagctaatttaataaatggtttctgaaagactatatgcaaggataggtcccagtcataaagagctaatacctgctttgaaggaacttacaattaatttaataaaaaagacagaaatgttgtacaaattaaaatggcataagtgccaaagtaaaactggaaaatctggaaaaaaatcataggttcttgaaagatgaaatttcaataggcaaagataaggacatggtaagttaagggataggatggacacagatatagcaacgtgaagtcaagagcacattgagaggtaagtaaatttgtccggatgaagtgagatattttggcaggtgagagtggaaagaaaattcataattgaaacatgaagtgtcttgaatgctttgctaaactttaggagtaaaataaacataagaaatgttatgggctgggtgcaatggcttattatctgtaatcccagaactttgggaggccaaggctggaagatggcttgagcccagaagttgaagaccagcctgggaaactcagggcaatgctgtctctacaaaaaattttaaaaattatccagatatggtgacatgtgcctgcagtcccagctactcagtaggctgaggcaggaggatcacttgagcccaggaagtcaaggttgcagtgagttgtgatggtgccactgtactgcagcctgggcaacagagtgagactctgcctccaaaaaaagaaaaaaaaagagagaaatattatggaagtggaattgatagggcttataaacaaactgaataacagcatgaagaaaaaaggccaagtcaaagatgcttatgagctctctaggctgtataactgagacaatattataacttaaaaaaaaaaaaaaaaaaacagaaaaaaaggaagaagaacaagaggagcagagttttctagtgagaagatgaagatacttttgactacactggtgtaagtgaccttaagagaattacaaacaggattctggttaaataatttattattatgcttgtagttgagggtagatattttgttttagctccctggcaaacagaaccttataggtattcaataaatgtttgctgagtaaatgacattttgatgtatctaaattaatgttacttcaggagagcacctaaacaccaatgttgagaacgtttttgggaatactttaattatgaacttttagaacactagtacaatttttttctaacaaccagaaaaatttcttgtccctaataattcttttcaatgtgccattctcagagccccagctgggtgcagtatatggctaagcaattaatatgggacagctagagttttaaaaatatatagtctatgagaagttacaaatttttaaaaacatattctttttttattattatactttaagttttagggtacatgtgcacaatatgcaggttagttacatatgtatacatgtgccatgttgttgtgctgcacccattaactcgtcatttaacattaggtgtatctcctaatgctatccctccccactacacccaccccacaaccatccctggtgtgtgatgttccccttcctgtgtccatgtgttctcactgttcaattcccatctaagagtgagaataagaggtgtttggttttttgtccttgcgatagtttgctgagaatgatggtttccagcttcatccatgtccctacaaacgacatgaactcatcattttttatggctgcatagtattccatggtgtatatgtgccacattttcttaatccagtctatcattgttggacatttggcttggttccaagtctttgctattgtgaatagcgccgcaataaacatacgtgtgcatgtgtctttatagcagcatgatttataatccttaaatgggatctaattaaactaaaaagcttctgcacagcaaaagaaactaccatcagagtgaacaggcaacctacagaatgggagaaaatttttgcaatctactcatctgacaaagggctgatatccagaatctacaatgaactcaaacaaatttataagaaaaaaacaaacaatcccatcaaccagtgggcgaaggatatgaacagacttctcaaaagaagacatttatgcagccaaaagacacatgaaaaaatgctcaatatcactggccatcaaagaaatgcaaatcgaaaccacgatgagataccatctcacaccagttagaatggtgatcattaaaaagtcaggaaacaacaggtgctggagaggatgtggagaaataggaacacttttacactgttggtgggagtgtaaactagttcaaccattatggaagtcagtgtggcgattcctcagggatctagaactagaaataccatttgacccggcaatcccattactgggtatataaccaaaggattaaaaacgtgttcttatttttaggataatactacaaaacttttctaaaataaatgctctaaaactttttatttgctctctagtatttattgatatggttagctttctggtttcttaatttaccgtacatggttatactcattattaaaagctttttaaatatgatgctgtgaaaggtgttacagagagcaactgcataaatagttctacttatgacagggtaaaaaccactgagcaaacatacttaattgaatggatgacttcttggggaataaaaaagcattataatgtaaaactgtaggtgaaaacccttctcaagttcattgatgttagagacaaacgttttcaactcttttcatttcctatttgctctttgccaagattggaatagtaagtagttaacctgattggtgagaacctcatagttattgagccatatcctagaatcagtaggtaggtttcttttgcctcaaaagtgagaaatccattcctctgtctgttttgcattgtttggatgagtaaactctcctcttttcatttgttattctcagtagtaaacacatgtgggtcaggacccctctaaaaggcatccatttctcttctccagcctctagtgaactccagtctgctcatgatagtgtttttgaggcaagtccttcctcatagttaactgcgtactcaaagtctgctctgaaggatcagctttccagacaggaggagacacgatctatggagaagccttatgtttactccatttttccaaggagatcttacttgggggaagcactggccctccactaatggaactatgttcatccccacttggctccttagtgtctgttctctactgactataacccagaaggaatgtggatattattgtatttttaataggctttattttttagagcagttttaggctcacagcaaaattgagcagagattacagagagatctcaaaaatccccgctctctacaacctacagaatgggagaaaatttttgcaatctatccatctgataaaggtctaatatccagagtccacaaggaagttaaacaaatttacaagaaaaaaaacaaacaaccccattaaaaagtgggtaaaggacatgagcagacacttctcgaaagaagacatttatgcagccagcaaacgtatgaaaaaaagctcaacctcactgatcattagagaaatgcaaatcaaaaccacaatgatttaccatcttatgccagtcagaatggtgattattaaaaagtcaaaaaacaacaaatgctggtgatgttcagagaaaaagaaacacttttacactgttggtgggaatttacattagttcaaccattgtagaagacagtgtggcaattcctcaaagatccaggagcagaaataccatttgacccagcaatcccattactgggtatatacccaaaggaatataaatcattctattatgaagacacatgcacatggatgttcactgcagcactattcacaataaaaaagatgtggaatcaacataaatgcccatcaatgatagactgcataaagaaaatgtggtacatataccatggatactatgcagccataaaaaggaatgagatcgtgtcctttgcagggacatggatggagctggaagctgttatcttcagcaaactaatgcagaaacagaaaaccaaataacacatgttttcacttatatgtgggagctgaatgatgagaacacatggggggaacaacacacactggggcttgttgagggggttgagggacggagagcattaggaagaatagctaatggatgctgagcttaatacctaggtgatggattgatctgtgcagcaaaccaccatcgcacatgtttacccatgtaacaaacctgcacatcctgcatatgtaccctggaacttaaaataaaagttgatgaaaaaaaaatcccggctcccacacacttcctctatgaccaacattccacaccagagtggtccatttgttagaattgataaacctatattaacacatcatggtcacccaaagttcagagtttacattaggttccctcttgggtttgtatgttctatggcttttaacaaatgtataatgacatatttccatcattataatatcatacaaaatagtttcactgccctaaaaatcctctgggctctgcctgctcatccctccctcctctcaattcctgacaaccactgatctttttactgtgtccatagttttgcccctgttagaatgtcatatagttggactcgcacagaatgtagctatttcagattggcttctttcacttagaaacatgcatttaagtttactccaagttgtctcattgcttgataggtcatttcttttcagtattgaataatattccactttctagatgtaccacagtttatttattcactcacctaatgaaagacattttgattgcttctgaattttgataattatcaataaggttgccataaacatccatgtttatgtgcaggtttttgtgcggacttaagttttcagctcatttgggtaaatatcaaggagtgtaattgctggattgtatggtaagtctttttatttttgcaagaaactgccaaactatcatccaaaggggctgtacagtttgtacaactcccacctgcaatgaatgaaagttcctgttgctccgtacccttgccaagatttagtggtgtcagtgttttggattatggccatcctaataggtgtgtagtggtctctcactgttgtgttaatttacaattacctaatgacctatcatgttgagcatcttttcataagcttacttgccatctgtatatcttatttcgtgaggttcctgttgcagtgttgtgttcattttttaatctggttgtttgttttctttttggtgaagttttagagttctttttatattttgataacagtctttatcaaatatgtcctttgcaaatattttcttccaatctgttgcttgtcttttcattctcttgaaagtgtattccacagagcatagatttttttcccttctctttcacagaagggaacagcatggaagaacatacattttaatgttaaggaaatcaagtttatctattatttctttcatggagtgtgcctttgatattatacctaaaactcattaccataccaaaggtcatctagattttctatgttaccatctacatttatagatctgtgttttacattcaagtctatgatatgtttcgaggtaattttgtggaaagttttaaggtctatgtatagattcctttttttttttgcatccatgtggaggtccatatgttttgtcatgatgtatagttgaaaagattatgtttgctccattgtattgcctttattcctttgtcaaagatcagttgacaatatttttgtgggtctatttctggactctattctgtttgattgatctctttgtctagtcttttaccaataccacattgtcctgattatcgtagctttacagtaagtcttgaagttgggtaatgtcagttctctgattttgtttctctctttcaatgtcgagttggcttttctgggtcttttgcctgcccaaacaaatttttaaataaatttgttcatatccacaaaataactttcaggaattttgattgggattgcattgaatcaagttaggaagtactgacatctgacaatactagtctttcatgaacataaaatatttctcaatttatttagttcttttatttatttcatcagagttttatagttattactcaaatagatcttgtatatatttttgttagacatatatctaagatgttaatttttgtggtgctaatgtaaatggtgctgtttttaatttcaaattccatttgttcactgtggcacataggaaaacaattgacttttgtatattaatcttgtacctgccatcttactcacttagtagttgttccaggagttttttttacatgattcttttagaatttttaccgatacaatcatcttatctgtaaacaaagacaaatttatttcttccttcctaacctgtataccttttatttactttccttgtcataattcattagttggacttccagtacaatgttgaaaagaagtggtaagaggaggcatccttaccttgttactgatctagaagaaaagcttctagtttttcaccaatgagtacaatgttacctgtaggattttagtagatagtttttatgcagttgaggaagtttccactctattctagcttgctgatagttttttatttttaatcatgattgggcattggattttgtcagatacctttctgcatctactgatatgatcatgtgatttttcttccttagcctgttgatgtgatggattacattacttaatttttgaatgatgaactaatctcatatatctgggataaatcccacttggtcatggtcatggtgtatcctttttatatgctgtttaattcaatttgttaatactttgttaagaatttttgcatctatgtgcatgagagatattggtctgtagatattggttctataatgtttttgccagattttgatattaggaatgctgaccttatagaataaattggaaagtattccttctgcttatgtcttctagaaatagctgagaaaattgtataatttcatccttaaatgttttgtagaatttatcagcgaatccacctgggcccagtacattctgttttggaaagaaacactgattcaatttctttaatagttataggcctattcatattatccacttcctcttctgagttttggcagattgtgtctttcaaggaattggtcctttttatctaggttattgaatttgtgggaataaagttgttcatagtattactttattatccttttaatgcccatgggatctgtagcaatgtcttctcttttatttctgatataagtaatgtgtgtcttctctcatatttttcttagttagtttggctaaaggcttatcaattgtgttgatcttttcaaagaaccaggtttttgtttcattgaatttattgatttcctgtttttaattgtactgatatctactctaaattatattactttttttcttctgcttactttgaactcaattagctcttttctttctagcttcctgaggtggaagcttaatttattcattttagatctttctttttttctattaagaaatattatcaaatgctataagtttccttctactcattgcttttgctgcatcccataaattttgataagtagtattttcattttgttcaaagtacttgtattttttattattttattttattttattgagacagagtctcactctgtcacccacactgaaatacagtggtgtgatcttggctcattatagcctctgcctcctggggtaagcaatcttcccacctcagcctcccaagtagctgagactacaggcatgcgtcaccacactcagctaatttttatatttctttgtagagacagggcttcatcatgttgccaggctggtctcaaactcctgagctcaagtaatctgcctgcctcggcctagcagagtactgggattacaggtgtgagccaacatgtctggctgttcaaagtatttttacctttctcttgagagttctttgatttggtgttatctagaagtgtgttgtttaatctttaagtatttcgggatgttaaagctgtttttctgttactgatttttagttaaaattcattgtggtctgagagcagagattgcatcctttcaaatttattaaggtatgttttatggctcaggatatagtctgtcttggtgaatgttccatattagccggagcagaatttgtattttgctcttttgggatgaagtagtctataaatgtcaattatatccagttgactgatgatactgttgagttcaactatgtctttattgaatttttgcctgctgtctctgtccatttcggatagacaggtgttaaagttccaactagaaaaatgaaagttatctctttctccttatagttttgccagtttttaactcatgtgttctttttttaagaaaaagggtctggctatgttccccaggctggcctcctgggcttaagcaatcctcctattcagcctccagagtagctgggactaaagatgcataccaatgagcctggcttgactcacgtattttaatattcttttgttaggcacaaatacattaaggattgtcatgtctttttgaaaaattaacccttttattattatgtaatgctccactttattcctgataacactcattgctggaagtctgctgtctgaaattaatatagctaatttaactttctttttattagtgttagaatggaatatcattctccatctctttccttaatcaatatgtatcttgtaaaaaacacatagttcggtcttatttttgacccactctagcaatctctgtattttacctagtgtatttagaccattgacatttaaagtgattattgatatatttgggttaatatcaatcatgcttgttcctctttgctattcattgcccttctttgttcctacttttgtcttccattcttttcctgccttttgtggttttaattgagcattttatatgattcaattttctgttagcatatcaattatacttctttataaatttttgtaatggttgcctgagagcttacaacatgcgtttacaactaatacaaatccattttcttttctttttttttttcttccttcttttgcccaggctggagtgcagcggtgtgatctcggctcactgcaacctccgtctcctgggttcaagcaattctcctgcctcagcatcttgagtagctgggattacaggtgcctgccaccatgcccggctaattttttgtatttttagtagagacagggcttcaccatgttggccaggttggtctcaaactcctgacctcaagtgatccacccacctccacctcccaaagtgctgggattacaggtgtgagccactgtgcctggtcaaagtccactttcaaataatactatatggctttataggtagagcaaacactttataataatatttctaattcctccctcccatttcttgtattattgctctcattcatttcccttaaacataagctatagtcataaatacattattgctattattaatttgaacaaattgttatctattagataaattaagaatttaaaaaattttatctttgtgtatttcctttcgaatattcttccttttttacatagatgtgagtttctgatctacatcattttccttctctctgaagaccatcttttaacatctcttgcaagccaagtcaactggcacaaaagttcttcaatttttgtttatctgtgaaagtctttgtttctccttcacttttcaaggacagtttcacaggatacagaattctaaggctggtgttgtttttttttttttctctctctcaacattttaaatatttcatgccactctattcttgcttccatggtttctgatgagaagttggatgtaattcttacctttgctcttttatgggtagttttacctctgtcttctttcaagattttttctttatctttgacttttctgaagtttgaatatgatatggctaggtgtagtctgtttggacatttaccctgtttggtcttttctgggcttccagaatctgtgacttggtgcttgacattcatttgtggaaattcctagtcattatggcttcaattatgtcttctattcctttctgtcttccttttccttttgatattcccatttcatgtatgttacaccttttgtagtgaccccacaattcttggatattctgtttcattgttgttcagtatttttttctctttgcttttcagttttagaagtttctactggcatattctcaagcccggagattctttctcagctttgtccagcctactaataagcccatcaaaggcattcttcatttgttacagtgtttttgatatctggcatctctttcttacaattttcatcctgtttataatactcatctgttcttacatgttttctatttttttccgttagagatcttagcatatttaacataacttttaaattcacagtctgataattccaatataccctccatatatgagtctggttctgatgtttgctccatttctttaaactgtgttttttgccttttaatacacgttgtaaattttagttgaaagataaacatgatgtactgagtaaaaggacctgtggtaagtaagactttagtaatgtggtgataaggtgtgtgtgttgggggtggggagaaaattctatagttctatcactagatctcagtcttttagtaggcctgtgcctctgagctgtgaatgtcaaaaaatgcttttctggtttttttcactcccttagttggtgcaggatggttagaggaggccagagttggatattttccttcaactatgtggaaggctagaggaggctgactagagttgggaacagaacttctccattaaaatcttactatcagtttttatgaagttagcagtcttggaagtttagatcaaaaataacatcccagagacttccagtttccatttctacatgtaaggatattagaagtcatcactctgtcctaaaaacaaataaaaagctgaagaaactgaaaaatcaacaactcttcttagatccatcagatctaagttggttaggctctgataaaaacatgtgtaggttaggctctgataaaaaatttttttttggggggcagactttgtaagaagaacagaatactgtggtatatttcacaatggttaccctcctctttccttgatactttccctctcctcctgctggttggctgcagaaggtaaaacttaaaaaagtgtgggcctctcccatcccataattggggacctcctcgacttttccacacagagctttagccaagttttaaattacaattcaggtttttgtaccctgctcctggttcccaaagaggttttcattcctgtaagttatgattctctgaatctgtctaatcactcctattttttgggcagcagtttgccctgtgactcacttctctgatggatttaagaagaattgttgatttttcagtttcttcagctttttatttgtttttaggacagagtgatgacttctaatctccttacgtgtagaactggaaactggaagtctctgggatattatttttgaaccttaaatttccaagactgctaacttcataaaactgataataaaattttaatggagaagttctgtccccaagattacttaaaaatcatagttggacatacaagaaaactttaattcatttaaagaaaaaaagcttcataaaaatatattagcatttttgttaaaagtaggctgaaaagaaacaaaaaggaataatatcttaagctctaaatctactgtcctagactatccatttatttgggatgaagcaagccattccccaaatgaggtatgcaaacagtatgatattaaatgtgatgagactgatttctgtgtgcatttgagagtttagatttcttatttaaatttaacttgtacacatgtggtattggtgaattaactattatttatagaaaaacatgttgttctatttccttttattatccaaactctatgcagttttaagaaattattttgttgtttcattctgcttacacatggttgtacattacttattccatgatgcggcagagtgggattactaacagtggcatgttctaagcatacccagagattgagattctatactttgtgtataaaggaaacagtgtgaatgtagggagtgtgttgagagagagggacaaacagagagagattgatttcaaaaaagagagtgcaagaatatgcacccctaaatagaaacacagaaaatctccttttcctataaatgtctccaaaactgcaaaatcaaaaatgaaagaaaacaaagggggaaatgagttatatctaaacctgcagttttagttctgatgttctagaactcctcaattagttcctgagcaaactgtagtccacactcagtgaataattttggtaaataatacatttccctctcttccacagaccctggccctactcctaataactgctttgtagaaatggcctactaaatagaccaagtcatgggaacatatgtatatttacaaaggagtccaatcacttacactggcagatgaggactattcaagttcacagaaaactttgattcaaggccatcaatatactgacgtaaattaaaaagcaacctttactaatgaaaaaaatcaatgaataaaatttgcttcaaaagtttaaagttagcaagcagcaaataagaaaataaaaatttaaaacttcaattacttgtgcttcatcatttttaatcaattttttgttctctatagggaacaaaattctatatacttctggaagccaaaatctctttctctcataggtttaatcaaacagaatatttagaaaaacatacacaagaaaatctctttataagtatttgctgacaacaacactatgctttaaaattgtagtgggaaagcaagtgttatacaactttttacaaggttgctgctgttttaaaacttagggcccaattttaataagaaacataattatttccaaaattataatgttctttctagctaacttaaaactaaatgtcaaagtaggttttaaataaaatcctttaatcaatgatgtttctaatcccaaaaatttaacataaaaaagtatgacaaatattaaaacatacacctcctaggcaatattttgtttttgtttttatctttgaaagattcaagaaaatatttcctctttgttcacatattgcttgtaacaaagctgatcatctgatctggagtatattgattaagtagtgtctttgttgtctcatgttttaatatttatcaaacatatttctcatcttctcttcatttacattttttgtttcacataccatttgtaataattacattcaatactcctcttagaggacaagaaatgtatgtctccttttttgtctgtggttttatttcttctgtatctgataagacagttttagtttcttcctgtgcagtattattaggatcaatgagactctgtagtaaaacaagaaaatctttaaggaaccatactttctgtataattttatgaatgaaataaaccaccaaattttagaattaaatttatattattactgtcaatgcgaggaatcacagatacaaaagaagattcatgctccatatcagtagctgtttggggatgtaacagcagtgtattttgcaaggtaccttgattgaaccttttatagacttgggtccccactattttcaatcatttgtgtatactgaataaaggtgcctacagtttgggcacaataattaaaagtgtccatcctctgtatacatcccaaagattattcaccaaaacttttgtgaaatgaaaatacaactcaattagaaaggaggtgaaatataattttacttggattcatctcatttgataaatttatataactgaaagaaaaatgagaaaaacataggtcaagccttcggaaattcaagcatgcttccactaatatttatagataacatattaaatagtgcaagggtataccttaatctcccaggccttttaatggtagcctgattatgaaactgctgattttgaaaaaaaggaatctttggtttgtgagaatattgagaaacttcttccaatgtaaaaaacaaaacataaacaatgataacaacaacaaaacaccagagtagagttaactctgcagtagaaatctccaaatttgccttatgattgtcatgggtgggtgggtgtgggggtgtgtgtgccagcaatttgagtgacttgataatactttgagtgagtgaaagagggaacatcttatcatcacaggaaacaataaaaaggctagagtgcatggacacattgaggaagggaattttacatgtaatgactaaggagacagagatatcaaggcagctgatggttaaaaatgaattatgtagctctttaagatcaaagttcttcaaatctgatcataattaacctattggagttctggtatagaggcaggctttttctgaaaattctgttactatataaaagggataaagacacaatggtgaatttttattaaggtgggtgaaaggtcatgtagagtaaaaccatattattttaagttttattattttagaatttgtaataaactgatgtagactaagatgacttcttcacagataattagaatcaatggtgaatatttaaaatatttttaaaaatgactttttgacccttaagaactgtagaaatctctattttaaaaaaatacgaaatttacaattctaattatgagcaattattactaagtaaaactagatcaacaaaaggtctaacgacttgctctatatatctataaaaataaaaaacttgggtctcttcaaaacacacagcacaacattttaattaatctagacttatctttacctctgttagtttaagttactgagttttccctgaatgtggtgagaaataataagcgacatttcttcttattcctaaaatctgtgctctttagctccaaaatgctctatagtcacacctttccatttgtttcattatttctgctcatttcctaggacccattacaactagctattttaaaatttaccacttttcatttttaaccagatatataaaagaaacctatctaataagtaaattaggaataaattttaagatcaggttgattttatatcatatattacagtatacttttaagtttttacctgaggagttgtagatgtttggaagttttcatcctccaaatgttcattttttgattctgtggtatgcatgctaagatttaaaagaaaaatactttaaaagaagaaacaagactataaatccatatgaaaacaaacatggttaagtgggattaattttttaaaggattttttgttctaaagttgtatcacagtcaagtcagatatctttatagtcaacatagatccaaatattcatctttaacattattaaccaaagccatatgcataagttttaaaaaccattatcatacagaaatgtaatatttctcaacagttcataatgctggcccatatcatagaatcatgtatcagaaaatgcagaaatttattttatgcactgaactggtgtgtttgagttaatatccactgttgatttaatctatcttctgtcatgctcttacataaaacactccagaaaaattttaaatgaaatatgaccaactacattaatacctacatctataagttactgatacatactatctttttatgtggcccatttgaaggatctgtaggtccaacatttaaatatatctataaagttttattttgaagaagaataaactagatgaataaaataataattacttataacttttattttaaagtatctgttgtttctacctcctctgtaatctttgctagcttcaaatataagtagggtaacttttcttaaaaatatcttctctcaatttttgagttgttgttaagaacaaaactaaagatttcaagttttaatttttagatagtcttattaccatatcctgtagtgcttcaagtatctatacttttctaaaaggaaaacaattttaataatgaaaattgttaacgaaaaggaacattaacagttgagtagctaccatatgctagctgctttacatctattgtcttaccataatgaagtaaaatattactgcataaaatcctataaagaatcataactgaatttataacattattaaagcaaaaaataacctttaaaaattttgatcagaaacttagatctaaattcctttaaagtgtagttccattttgattgaagtgactgtcaaaataactatcttgtcattagaatgatgtattagtccattttcatgcagctatgaagagatacctgagtctgggtaatttataaaggaaagaggttgaattgactcacagttccacatggctggggaggccacaggaaacttaaaatcatactggaggggacctcttcacagggtggcagaagagagaatgagtgcaagtaggggaaatgccagacacttataaaaccattagatcttctgagactaactcacaagatccagctacctataccttgtcccacccatgacatgtggggattgttataactcaaggtgagatttgggtggggacagagacaaatcatatcattctgccccggcccctcccaaatctcatgtcctcacacttcagaacacaattatgcctttccaacagtcccccaaagtcttaactaattccagcattatctcaaaagcctaagtccaaagtcttgtctgagacaaggcaagtcgcttctgcctatgagcctataaaatcgaaaggaagttggttacttcctaggtacaatgagggtactgggagaaattggccaaaacaaagaggctacagaccccatgcaagtccgaaatccaatagggcaatcagtaaaccttaaagttccataatgatctccttttactccatgtggcacatccaggtcacgctgatgcaagaggtgggctcccatggccttgggcagctccgcccctgtggctctgcagagttacagtcccactctctggtgctttcacaggctggcattgagggtctgctgcttttccaggcacatggtgcaagctgctggtggatctaccattctggggtctggaggatggtggctctcttctcacagctcctccaggtagtgccccagtggggactctgtgtgggggctccaaccccacatttttcctttgcactgccctagcagaggttctccatgagggctctgccactggagtaaacttctgcctggatatccaggcatttctatataccctctgaaatctaggtggaggttcccaaagctcagttcctgagttctgtgcacctgtcggcctaacaccacgtgtaagctgccaagccttggggcttgcaccctctgaagcaatgccagagctgtacctggcctcctttagacatagctggagctgaagcagctgggatgcagggcaccatgtctcaaggctgcatagagcagggtgaccctgggcctggcccacaaagccatttttccctcctaggtctccaggcctgtgatgggaggggctgccacaaaggtctctgaaaatgccctggagacattttccccattgtcttggtgattaacatttgactcctcattacttatgcaaatttctgcagcaggcttgaaattctacccccttccccagaaaatgtttttttttctattgcatcatcaggctgcaatttttccaaacttctatgctctgcttcctcttgaacactttgccacttagaaatttcttctgccagatatcctaaattatcactctcaagttcaaagttctacagatctctggggcagaggcaaaatgccaccagtctctttgctaaagcatagcaagagtgacctttactccaattcccaacaagttcctcatctccatctcaaaccacctcagcctacacttcattgtccatatcaccatcagcattttggtcaaagccattcaacaagtctctatgaagttccacactttcccacatcttcctctcttctgagccctccaacctgttccaacctcagcttgttacccagttccaaagtcgcttccacatttctgggtatctttataacagcagcccactctgtggtgccagtttacattagtcctttttcacgctactacaaagaaatacccgagactgggtaatttataaaggaaagaggtttaatggactcacagttccacatggctggggaggcctcaggaaacttacaatcatggcagagggcagctcttcacaaggcagcaggaaagagaatgagtgaaagcaggggaaatgccagacaattataaaatcatcagatctcatgacgtgatcacatcagatcactcattatcatgagaacagcatggggaaaccacccccatgatccagttacctcctcattgttccacccctgacacatggggattattacaattcaaggtgaaatttgggtggggacacagaatcaaaccatatcaaatgactaccttgtcataagctgttagattatgaggtaattggtaagaataagggaggtaggtgaatcacctaagttgtgtcatgttctgaatagacagactgggagttagagccattaaaaagtttgagctgaagtgcacataaattttgaggagaggacacaaaattaatttacacacttaataatttttgaatgcctactcttctggcctctgaaggcaaagcagccaatcaaaacaaaataaaacagaaatataggcttctgttctcatggatcttatactcttgttaggtggaaggggaagattataaaaaacattttcagtactgcagaaaataaatgaggatcatattatagagatcaaggtgacatttgaactgtgtcctaaatgaggagaagctgtgagtcataagtaagcagatggacaaggagcaggcaaacataacaccaagaatcatacaaatggagacatcaagcgactaggcagcatattttaagatatgtaactataatgattaggatagcagggcttggaacccaggcaagcagactatgtattagaacttcaaaacctaagtaaggggtctgaataatagatgcacaggttaatagctataagagaagctttatactgagtcaagcaatatttgtgactggcagtcactcaataccctctttatatatctgccaagagtggaattggtaggtggtatgcctaaaagcaaggactttgagttgagaaagaaatgtattcaactcttctcttatcttttcataactgtgggaagtgatttatctccactggcctcaatttccttatctgaaaaaatatataataatgcttagtttattggttatcataataattaaattataatagctaatgccagttgaactatattaagcacttaacatgaatcatcttcctcaattctctcaacaactctatgaggtatttaatactattatccccattttatagatgttcaaactatggatgcaggaaagttaagtaatttaactttcaatatggtcatataactagcaagtggggagctggaatttaaatgaagtactctttaatattactcagatctttgtcaactttagtattgtctcttttttcttttaactgttgtggtgacattgcattatgaatttaaattgcatttctataatgagcattttttcatatatttactggccatttgaatatcttctttagtaaagtgttcaaatctcttgtccatttttttgttgtactggatcccattttcatactgatttgttggagttctttttaggtattaaaaatgtaaatcttttattggatatataaagagccaatatcatctcccactctgtgtcttgcttttttacgctgataataccttttttaaaagatactttaatttggcccaatttattctttcctttctttatccttagagcttttgttgtttaagaaatctttgccaacccatgtaggagaatgtttattctcctatatattcttccacaaacattattgttttgcttttcacataggaaaggaacaacaacaggtctatggtctatgagccatctggaattgaatttcatatatgggatgtgaggaagagatcaaagtttatttttcccatatcaatatctaattgactcagcacaatttattaaaaatatcatcctctatacattgtattgcaatgccacttttttttgtaaatcaggtaatcacacatatatgaatttattttcatattctatcctgttccactggcccatttgtctatccttaggctaacattatgctagtgcttgtatttttttttctgagatagggtcttcctctgtcacccaggctggagtgcagtgacacaataatagctcactacagcctcaatctcctgggctcaagtgatcctcccacctcagcctcctaagtagctgggactacagccacaagccatcatgtccagcaatttttttttttttaaatttttagtagagtcgaagactcactatattgctcaggctggtctcaaactcctgagctcaagcaatccttttgtctcagcctcccatagtgctgacaggcatgagccattgtgtctggccagtataacagatattgacatctggtgttggtgtacattctccacttttgttgttcttcagaattggattgactttttgatcctttgtatttccacatacattttaggaccaagttgtcaatttacacacacacagctggaattttgactgaagttacattgaatctatagattaatttggggagaactgacatcttaacaatattgagtcttccaatctttgaacactgtatattcctccatttatttagattttcttgatcttaataattttttgtgttttcaatgtacagaacagtatgtctttcattaggcttatttttaggtattttatgttttttggatggttataaaaattataactttaaaaattcattatttgtttcttgctggcatacagaaatatgaataattttcattcatttcactttgtatcaggccttgataaattcacttaattctaatagtctgtagatttgtttggattttctaagtacatacatacacagtcagcaaatataagttttatttcttcctctctaaattttatgtatttttctccctttttctttgtttttctggctttaacctgctgttacagttgttctaaatcattgctaaccttggtattgtctgtcttcagaatttgttttaatatagatctgttggcgataaattccttatttctttgcctgaaaaatatctatacttaaccttcacttttgaaagtgattcttattagatataggttagagtttattttctttaagtactttaaagatgttccactgtattctggctcccatagtttctgttaaaaatttaactgtcattcttgctatgattcctttgataataataatatcttttttactttggctgatactaatcacaattattttaagcaattttcctgtggtaaaatatgcataaaatttaccattttaaccactttaaagtatatagttccaggggcattatgtatatttgcattgttaagcaaccatcaccaccatccatctccagaactttttcattatcttgacctgaaactgtgtatgtattaattaaacaataacttcccattctcccctcctccaatccctgatagccaccattctcctttctgtctctatgaatgtgaatattctaggtactttatatgattcaagtcatacaatatttgcccttttttgtcttgcttattgcacttatcatgccttcaaaattcatccaaaatttattcaaaattctgtacatgttgtagcatgtacagaatttccttcctttttaaaggctgaataatatgcatttatatgtatatatcacattttgtttatccattcatctactgatagaccttttggctattgtgaataatgctgctatgaaaataggtgtaccaatatctgtttgaatccctgatttcaattctatttggtatatacctggaaatggaattgatggatcatatggtaattctatgtttaatttttggaggaaccatcatcatatggttttttttttttcacagcaggtacatcattttatattgacatcaacgatgcacaatgattccagtttctccacatgcaggcaaacacttgttattttctgttttttggtaatagccatcccaataggtgtgaatggtatctactgtagttttcatttccacttccctaatgattaatgaggttgagtatcttttcatgtgcttactatttgcatatatcttttttggagaaatgtctcttcaagtcctttgtccatttttattcttatttttttgagacaaggtctcattatgtcacccaggctggagtgcagtggcacaaacatagatcgtgcagccttgaactcctgggctcaagggatcctctgcctcagcctcccaagtggtaggactactggtgcacacgtccacacccagcaatttatttttttgtatagccagggtcttgctgtgtagcccaggctggtctcaaactcccagcctcaaagtgctgggattatgggcatgagctattgtacccagcatctttgcccattttaaaattgggatgtttgtttttttccgttgctgagttgtaggagttctttatatactgtaggtattaatatcttattagtaatatgcaagtattttctgtaagttgccttgtcactctgttgatagtgtcctttgttgcacataagttttaaatgttaatgtagtccaatttatctgtttttccttttgttgcctgtacttttggcatcatagccgagaagtaaactgccaaatccaatatcatgaagctttccttctatattttcctttaagagttttaatatttttagtttttataatcgtagttattgtaacctctttaactcaaaaatctggatcccttttgagtctgtttcccttttcaattttctatcttggcttaaggtcatataacattgtctaatactatggttcacaatttttattgaaagtttgacattgtgtacaaattgtacagtctccagatgataacttcttttggaaagaaatatgtggagtagggggagtgaaaaaatcactttaaccaaatcagagattgagctcagttgatagctttgtaatgctcagttttatttcaatttgtccttgttcctcaagtatagtcctttagggattttgccctaggtgatttccttgataaattatggcagtgtcacttgattcctcccatatcaggcattgtattattctgttttcacacttgttctataaagaactgcccaagactgagtaatttaaaaaggaaagaggtttaattgactcacaattcaacatggctgaggaggcttcaggaaacttacaatcaagtggaaggtgaaggagaagcaaggaccctcttcacatggtggcagaagagagaagtgcaagcaggggaaaatgccagatgcttataaaaccatcagatctcatgagaacgcattcactgtcttgagaataggacgagggaaactgcccccttgatccagtcaccttcctcccttgacacatggaaattacaggtctcttcctctacacatggagattacaatatgagatgagatttgggtggagacacagaaccaaaccatactgttctgcccttgccctcccaaatcgcatgtcctttatacatttcaacatcaatcatgccttcccaacagtcccccaaagtcttaactcattccagcattaactcaaaagtacaagtccaaagtctcatctgaggcaaggcaagttttcaaaaccaatcatgccttcacaacaatcccccaaagtcttaattcattccagcattaactcaaaagtccacagaccaatgtctcatctgaaacaaggcaagttccttccacctatgattctgtaaaatcaagagcaagttagttacttccaagatacaatgagggtacaggcattgggtaaatattcctgttctagatgggagaaattggtcaaaacaaaggggctatgggccccacgtaagtctaaaatccagtgggggcagtcattaaaccttaaagctccaaaataatctcctttgactccatgtctcacatccagggcatgctgatgtaaagggtagactcccatggcctagggcagctctgcctctgtggcttggcagggtatagctccatgcctggctgctttcacagctggcattgagtgtctgccgacattacaggggcatggtgcaagctgtcaatggatctaccattctggtgtctggagaatgatggtcctcttctcacagctccactaggtagtgccccattggggaccctctgtgagggggtccaaccctacatttcctttccacactgccctagctagaggttcttcttgaggctccacccctgtaccaaacttctgcctgggcatccagtcatttccatacatcttctgaaatctaggtggaggtttgcaaagctcaattcttgacttctgtgcacccatgggcccaacaccacgtgtaagccaccagggcttggggtttcaccctcttgaagcaacaacctgagctgtacattggcccctgttagccatggctgggatgcagggaaccaagtcctgagagtgcacaaagcagcaaggccctgggcctggcccacaaaaccactttctcctcctaggcttccagacctgttatgggaggggctgccatgaagatctctgatattttccccattctcctcattacttacgcaaatgtctgcaggcagcttgaacttctcccccaaaaatggatttttcttttctattacatggtcaggccacaaaatttgcaaactcttatggtctgtcacctcttgaacgctttgctgcttagaaatttctcctgccagataccctaaatcatctctcttgagtatgaagttccacagacctctagggcaggggcaaaatgccagcagtctctttgctaaagcacagaagagtgatctttggtccagttccaataagctcccatctccatttgagaccacctcagcctgaaattcagtgtccatatcaccatccagcattttgatcaaaaccattcaacaagtctccaggaagttccaaactttctcacatactcctctattcttctgagccctccaaactgttcccacctctacctgttacccagttccaaagtcacttccacattttcaagtatctttatagcagtaccccactcttcacagtaccaattttctgtattagtcccattttcacactgctataaagaactgcccaacattaggtaatttataaacaaaagaggtttaactgactcacagttctgcatggcttaggaggccacagaaaacttacaatcatggtggaaggcaaaggaggagcacggaccttcttcacatggtggcaggagagagaagtgcaagaagggaacaggccaaatgcttataaaattatcagatctcatgagaattcactgactatcttgaggacagcatggggaaaactgcttctatgatccaatcacctctctccctcaacatgtgggcttacaggtctctccctcaacacgtggggattccaattcaagatgagatttgggtggggacacaggcccaaaccatatcaggcataccttaccatttcctaacttggtttatttctactgtccatactttcctatattggaagagctgaattaacatcttcaatgttacataactataaataaaggagttggagcccatcaggcagtctgactccagagcccatactcttaaaactaaactgcttataatgtgacaagtattctgtgcaagacacagactaaagctctcataagaatttataggctaacatttagaaaatgctgtaataacttaaatctataaaagattaaatgatctaccaagaaaagagaaaaaaatccaacaactatatgattttttgacttttccattttagaaaatgaactagtacgagtaacttctttaggaagtaaaaaagagtcttaagaaaaacttaaaaatagaaaataaaggatgaataagtcacagaaggctaaaatggtttagaaatagcccattggaaatcaattacaaagctgttcagacccttggggattatgccaataatgctattccattgcctctgagcagccctatccatggtccttaactctcgagtgctttcactgaacactctggaacttctgccagatgattatcaaactgtattatattctcaacctcttttcaaagcattctctcaaattctgtgccctatatgaaaccaagcccttcctttaaggaggacactgcttcccctatagtcctctcacataacagcagtttattcactaacattccttctgacaccctactgctatttctaaaacttcttatataaaaaagaaacaaaatccttgcttttttaaagcttgtataatttgacaatatcaccttcctccccttctactcactgttacttactcaccttattttgatccctttccattattcaccaaagatgttggtgcttgacccccatatttgtaatcttttcatcttacacacttggataattcatctactatcttgtttcttcagttctttacttcctttctaataaaggaaagaccacactaaaaccttctatcatctgaaatgctctattatcgataatcatgatttcaagcatctacatctctgaatactacttcatcttctttcagttctcttgttcagttgtattcacttcatcccctccaattattcttcactttcatcaggatgtgcagtgtaatgaaccctgtaactcaaacttttgccctcttccttctttacctgtttttgtattcaatacctgtgatccatcatcctcaaaatactgctataaatatcttaaactatcttgaaatatctttgttgcttcattgttgcacatttgtagaaacacctcaatctagggatgctgctgccctacttccactgatgcccctccccagctgacacacatgcacccttttgcactgctgaggcagctggcatgtgtgagcatgcaaagatcctcttgccactaccccagtgaagcactccaatgggggtaattccccattggagtactgtggcagtggactaggaataccttggctcctgcagcacagcaggttcctaaccttgaggggccagagaacagagctaggggcctggtttcagccccccagagctacagcacacagctgaggagagctcagctgagccttgaccccttaaaatcttccagaaatgaagccagccaactgaacccaccttataccacaaccaaacccccaagggcatcaaagaagataaaagcaaaaagccccatctataggacaacaacttaaatgttgaaggaacatgagcccacacagatgagaaataaccagcacaagaactctggcaactcaagatgcccgagtatcttcttacctccatatgaatgtagttgttcctcagcaatgattcttaaccaggctgaaatgacagacatataattcagaatatggatagaaatgaacattgacattcaggagaaagttgaaccccaatgcaaggattctaaggaatacaataaaatgatataggaacttaaaaatgaaatggccatttaagagagaaccaaactgatctgatagaactaagaaactcactacaagaatttcataatacaaccacaagtattaacagcagaatagaccaagctcaggaaataatctcagagcttgaagaccatttctttgaaacaactgtcagacaaaaataaagaaaaaagaacaaaaagaataaacacctctgagaaatatgggattatgtaaagagaacaaatctacaactcatctatgtcccagaaagagagggagaaagagtaagtaatgtggaaaacatatttgaggatatcatccatgaaaatttccccaatcttgctagagatgccaatattcaaattcaagaaatgcagagaacccttgtgagatactatacacaatgaccatccccaaaacacaaagcaatcagattctccaaggtcgaaatgaaagaaaaaagcattaaaggcagctagagaaaagaggcaggtcatctacaaatggaaccccattaggctaagagtggacctttcagcagaaactctacaagccagaaaagattgaggggcctatattcagcattcttaaagaaaagaaatttcaaccaagaatttcttatctagttaaaagaggcttcataagcagaggagaaataagatcctttcagacaaacaaatgctaagggaatttgttaccaccagatgtgccttacaagaggtcctgaagggagtgctaaacatagaaattaaagactgttaccagccaccacaaaaacacacttaaatacatagaccattgacactataaagtagaaactacacaatcaaatcttcataataaacagctagcaacatgatgacagaattaaatttgcatatatcaaagtatcaactttgaatgtaaatgagccaaatgccccaattaaaaggcacagaatggcaagttggataaagaagcaagacccaacaatatactgtcttcaaaagactcatctcacatgcaatgataactataagctcaaagtaaaggaatagagaaaaatctaccaagcaaattaaaaaaaaaaaaaaaaccagaaaaaagcaggggttactgttctaatttcagacaaaacagactttaaacaaacagtgatgaaaaaagatgacaaagaaggacattacataatggtaaagggttcagttcaacaagaagacctaactaccctaaatatatatatgaacccaccacagaagcaaacagattcataaaataagttcttaaagacctatgaagaaacttagataaccacatacaagcagtgggaagtttaaacatcccattgacagtactagacagatcactgaggcagaaaactgacaaagatatttgggacctgcactcaacacttgatcaatgaacctaacagacttttacacaacttgccaccccaaaacaatagaatatacattattctcatctgcacatggcacatactgtaaattggccacatgatcagccataaaacaattctcagcaaatttaaaaaaactgaaccacactcttagaccacagtgcagtaacaatagaaataaatactaaaaagaactctcaaaaccatagagttacatagaaattaagcaacctgtttcctgaatgacttttgggtaaacaataaaattaagtcagaaattaagaaattctttgaaactattgagaacaaagatacaatataacagaatctctgagacagggctaaagcatgctaagagaaaagtttatagcactaaatgcccccatataaaagttagaaagatctcaaattaacaacctatccttacggctagaagaaatagaaaaacaagagcaaaccaaccccaaggttagcagaagaaaagaaataaccaaaattacacctgaactgaatgaaattgggacatgacaagcaatacaaaaagatcaaggaatccaggagttggttttttgaaagaataaataagattatttaaagaataaataagattataaataagaacaaataagattatttgaaagaataaataagaccacagctagactaacaaagaaaaaaagagagaacatcccaataaacacaattggaaatgacaaagggacattaccccagagaaatacaaaaaatcctcagactattatgaacacctctatgcaaacaaattagaataactacaagaaatgggtaaatttctggaaacgtacaacctcccaagattgaaccaggaagaaattaaaatcctgaacagacaaataatgaattctgaaattgaatcagtaataaaaaggttaccaactagaaaaagcccaggaccagaatgattcacagccaaattctgccagatatataacgaagacctggtagcattcctactgaaaatattccaaaaaattgaagaggaagaactccccaagtcattctatgaggatagcatcatcctgatacccaaacctggcagagacacaataaaaaagaaaaaggccaatatccttgatgaacactgatgcaaaaatcctcagcaaaatactagcaaatggaattcagcagcacatgaaaaagctaatccatcacgatcaagtagactttatccctggcatgcaaagttggttcaacatatgtaccaataattgtgattcatcacataattagaactaaaccccaaaaccatataataatctcgatacagaaatggcttttaataaaattcagcataacttcatgttaaaagccttcaacaaataggcatgaaggaatatatcttaaaataatgtcgtttatgacaaacccatagccaacatcacactgaacaggcaaaagctggaagtattacccttgaaaaccagagcaagtcgaggatgccctctttcaacactcctattcaacataatactggaagttctagccagaacaatcaggcaggagaaagaaagaaaaggcatccaagtaggaagagaggaagtcaaacaatctctgtctgtagatgatatgattctacacctagaaaaccccatagtctctgcccaaaagctcctagatataaaaaactacagaaaattttcaggatacaaaatcaatgtaccaaaatcagtagcatttctatacaccaacaagtccaagctgtgagccaaatcaagaacaagattccatatacaacagccacaaaaagaaaataccctaggaatacagctaaccagggaagtgaaggatctctacaatgagaattacaaaacactgctgaaagaaatcagatatgacacaaagggaaaaacatttcatgctacagtatcttggcatcactataaatgcataacagccttgaaatcagaaatatactggttgtatgatcttgggtaatttacaatctcttgtcatcttttttttttttttttttttttctggagagatgggttctcactctgtctgtcacccaggctggagtgcggtggtgtgatcatggctcactgcagtctccaactccccagctcaagtgatcctcccacctcagcctcccaagtagctgggactacagacatgtcatgtctggttaattttttgtagggacggggtctccctatgttgcccaggctggtcttgaactcctgggctcaagtgatcctcctgccttggcctcccaaatctcatcagcttttattgggcatagtactatctgtttttcttcatattcacagctagggaaagcagaatcacatttgaggacagacacccaaatatgagttgactggataagtttattagaaattatggcctgctttttgtactaacaaaaataagacttcttactggtttatattccagtgtcttacatataaatgatcagctcagtttaaaaaatttttatgctttacttatttcaataagcttcttaaaatccttttcggaatgaggtagatataagtacatacataaacacacatatatacatatcttgctattatgggaattaagtgagatgtttgtacaacttatagcaaaagctatggtatttaaaacttattagaagtctgtactgctgttatattgctaggctttgctttcaaaatagtgaaaaattttgatggatttagaagttccattttcaccttggttttttagaatgtctgtttgattatatattaataatggacacagtgtggtattgtaaaaagaactgggcaatctaagttctctgtttttcatttgctacttttttttttttttttgacagaatctcaccgcccaggatggagtgcagtggtgcgatctgggttcactgcaacctccgcctcccgagtagctgggactaccgacgtgagtcactgtgtccgtctagtttttttattttttggaagagatggggtttcaccatggtggccagaatggtctaaaactcctgatctcaagtggtccgccagcctcagccttccaaagtgctgggattacaggcatgagacatcgcacctgaccctgatacatcatattgagtaaatttcttgtcatttcatctctctgctcgattccaaacctataaagtgacgtagggagtgaggatcttagatgatctaagggctttaacagtttcttttttttttttttttttttgagacggagtctcgctctgtagcccaggcgggagtgcagtggcgcaatctcgactcacggcaacctccgcctcccgggttcaagcgattctcctgcctcagtctcccgagcagctgggactacgggcgcgtgccaccacgtctggctaattttttgtatttttagtagagacgggtttcaccgtgttagccaggatggttttgatctcctgacctcgtgatccgcccaccttggcctcccaaagtactgggattacaggtgtgagccactgcgcctggccaggctttaacagttttaagtctatgattctattatctgaggggcataccaagaaataggctgaaagaatagcaatacgtacttcttgggaacttcatttcttaaataccatgtatgtgcatatgtatcacttaatataaacaacttgtctttccttggtgtgtccatacacaatactatgggtttatgcttttggagcaatgttgtgcaacagtgacatctagtgactacatatcacagatcattcagcaaaactttatggccaacttgtactcttctaaatgtggatgatttactttgtagcccagctaaatacttttaaataattcctcacctctctcctctaaagaaaggtatgccaattaaatttgacaacagcattaataattggctaaataagaactgaaatttcctttaaaaatcataatgtatatggaattcagtataaattattctaaatgagactgcagctcttttccttccactgagagtggcaaagctgggattttcaattccagtgtgtttaaatatagtctattctcttatctactatgcattgctgacatgtagtaggcatttaacacatacttattcaattaatgttaggtaaaacatatgcatcaacagttgtgagtatgtattgctttggaatctttggaactattgctgcctttcaaacaaagaactcttcttgaggtcagataaaagattaacacaattataaacaaccacagtatacatctttctgaacaaatgaatttgagacctacatgcatgcataacagaatactctttataaaaggcattcaaactaggtcagtattttttttaagataatgactacctagtattattatttaatcaggacaatacaaatctgggctaaacttctactactataattcaaattgactgtcattgttaaaattcctaatagtatttaggatttgatctcattagtcagatagtaccttgattttaaaccgttttcgggtgcctagatcttgttgccacaataaagtgacacggtgtctgtcttaggtcattttgtatgctgtaacagaataccacagattggataatttataatgaaaaaaatttctttctcatagttctggaggctgagaagttcaagatcaaggcaccccagcatcttgagagggccttcttgttccattctctggaggggagggagtctatgtcctcctcacatggcagaaggtataagggtaagggacgcaaatgggtggcagaacttgtccttttataatgaaattaacctcacccatgtgggcacagccctcaaggcctaataacctcttaaaggtcccacctcttgatactgttacaatcaacatgagttttggaggggacaaacattcaaaccatagtagtgtcttagtctatttgtgttgctttaacaaaatcctcaagattgggtaatttataaataacaaaaatttattttgtcacagttctggaggctggaaaatccaagatcaaagtgctgacagatttggcatctggtaaaagctcagatctctgcttccaaaatggtgccttgaatgctgcatcttctggaggaaataaatgctgtatctttacatgttggaagagacagaagggcgaaaaggggctagctagctccctccacttattttataagggcattaatccatttatgagggcagagccctcatgacctagtcacctcctaaaggccccagctcttaatactgttgcattggggattaagtttcaacatgaaattggagggacacaaacattcaaaccatagcattttgccccttcccccacaacaaattcatgtctttctcacatataaaacacacttgttccatcccagtagctccaaaagtcttaactgtttccgataccaactcaaaagtccagagtccagagtctcatctaaatcagatatgggtgagactcaaggtttgattcatcctgaggcaaattgctctccagctgtaagcctatgatatcaagcaagttatatcattctaaaatacaatagtgggacagacagaggaaagatagatattcccttttcaaaagggaggaaatagaaaaggagaaaggggtaataagttccaagtaagtcccaaacccagcaaggcaaacaacattaaatcttgagacttgagaataatcttctttgactccatgtcctgccttctgcatacaatggggaaggggttgagcccccatgtctcctgggagccttgcctgcatggctttagggggagcagaccatgcaccagttctcacatgttggcatcacatgcctgtcgctctcccaggcaggaattgcacactggtatctctagtggcctacagtcttggtggtggctctgcccccatagctccactaggcattgctcttatgggggctctctgcggtatccctgactccacagctcttgtaggcactgccctagtggtgactctctgtgctgacctcacacctctggcagttctgtgcctgggccccaaggttctctgtgacctcctttgaaatctatgcggagatagccatgactacagacttagcaccacatgggcaccaccaaggtttactgtttatactctctgacactgcacctgggcctgcttgagccacagctggtgtggctaaggaatgctgagccacatgtgtggagcagaaagttgacgtggccctaggcagcaagccctgagttcccatggacaccctgggcccctcccttgaaactgttctgccctgaaggccctggcactctgagcctgtgataagagtggtagcctcaaagatctctgaaataccttcagggccactcctccactgacttgatgaataacatctggcttccttccatccatactaatctgcttatcaaacatgcacttggccatattcttggtattctctcctgaactcagtctttacaacctggttaggctgaaaaatttccaattctttaagttctgcttcctttttgattataaattccatcttgaattaatttttctctttttgtccagtatcataaacagtcaagagaagcatgtagcaccctcagcattttgtttaggtatttcttcccctaaatatcctatttcattgctcacaggttctgcctttcacaaagcattaggacacaggtggaattcagccaagttctttgctactttataacaaggatgacctttcctccagtttctagtaagacattctttatttccactgaagaactcatcagaatggtctttactctccacatttctaccagccttctgatcatgattaacttagataatctctaagaacatgaaggctctttatacagctctcctcgtcttctgaaccttcatcagaattgcccttaatgctctgttcatggtaatctagactttttctaggaggcacttcacaactgttctagcttttattcactactagctacaaagctgcttttacaataataggcatttgttataggaacactccacttcttagtaacaatttcttagcccattcctgctgctatgccaaaatacttgagactgagtaatctataaataacagaaacctactttctcacaattctggaggctgggaaatccaagattaaggttcagtcaggttcagtgtctggtgaggtctctgcttccaaaagggtgccttgaacattgtattctctgaagggaatgaacattgtgtcctcacatggtggaaggcatgtaaaggcaaaaaagtcctagctagctgtccccaggcctcttgtaaggacttttataatacattcatgagggcagatccctcatgacctaaccatttcctaaaggcctcacctcttaatattgttgcattggagattaagtttcagcatgaattttggaagagacataaacagtcaaaccatagcataaaccattccaggcatgttttatattcttttctttctcttagcaccaaacacaatggtttttctcaactatagacaaagctaccaaaaacttacccagaatccaaggtttgctatacatggaatcaaactgtctcaccagctttctttctggttctttcttttgacccaacatttcagtcaaactgttaactgcactccatgcctttatttggttggaacatcttcccactgaacctctttgtaaatatccattgattattctaaataaagcttcctgcaatgcacactacataaactggatgtgtttttccccttttgaattctcacatcattttgttatttgctctaccatccttacctctctggtgtcctttctttgtctttgttagtggtttctttcccctattcatcctttaaatattgggcttcctcagaattcttctctatgccctattctcttctcactctatatacatttctcaacatctattctactattatggctacaattctaactaatatgctgaggaatttgaactagaaaagctctcaagattctatttagtatatctaattacttattgaatatctctacttgtcttacaagcatcttaagttagtatatgcacaaactcaagatctttccccaccaaagttattccttctctggataatttcctatctcagagaatgaagccaccatcgacctagttgctcaaaacagaaactgagaagtcattctttctcgctgcttttctttatctgctaaaatcaagtgaattactaaatcatgttaagacaagttactgaatgtttaaaaattttattcatttctttccagataaattgtcactagtccagtccaggccataagcatttccccacctaaacaccgtaatggctttccaacttttccccacatccagtcttgttcctcctcaatgtaattttcacaatgcagaacaatattcttaaatgtaagcttgattatggcaacaaccttcttaatattcctcaatgacttcccatagaagaaaaatgttaaaactccttacattcagcttatagggtcctttgaataaggctctaaccttgaccctgcctaccttctcattcatcacttgacactctaaactttagccatactaaatttttgttcttcaaacttgccatgtctcacatctccaaaactttatgcattctgtacgctgccttccaacaccaacactcttgcttttcatccagctaacgcttcatcaatttagaagtcatttcttccagaagatttcctgacgctaccttcaacatgcatccttatcatggcatccaatgcttatcacagcatccaccccactattttaatccttgtttaactgtcatcatttttaaatttgacaaatattcattgagagcccattatattacagatactgtattctcctctgtatacagaatgtggtaaatatagagtattgtagaagcacgtttaggatgtgagagaagtccaagaaatgctttttagtgacttgtgttcccatctatttccctactaaattaaaccagagacagtttcataatcatttctgagttatttgaattgcctaacatagtatatagtagataaatattttataccatcaattattggattttaaatacatactaaatattctttgcattgtaagaggccaccagccagccaatactttctacccagcaactttttctttgatatcactttgcatacaatagagtgtaaaaagcaaagagacaaactaatatagtggaaaatatgggacttagagtcagaacactgtgattaataattctgccacttactaggtatatgtccttcgtcaagacccttaacctctctgagtctcaatttcctcatctgaaaaaggccattaggagaatgaaatgagataaagagaaaataaaagcataaaatgtaagaggttatccaaaatgatgtctattattattattgttattaaagtcaatgcagatcaagtctccttatgactggttatcccagctctgtaaggctacaagattttcaaagttcattcttcatcttccctttaccatccaagagataatcttttgtactttaataaacacatattgatggaaatggttaaaaatcacaaagaaaaacaagcccaaaattgaataagtatacattaatgtatgaaagggacaagacaaaagtaccagcctatgacagtttataatttgaatgtatggaccaaaaaaaaaaaaaaaaaaatcaggccacaattttttttaatgttgaccagaagggtaggtaggtggcacaaaagagtaatgctgtgaactgtttcacagtaaaatggtaacccattgacctagaaagtcaagatatctgggctcaaatactaatttagctactaattcaaccactaatacccaggtggtctacccacccaacactctagtctttcagttccttgatctccttagctcctattgtctttttctttcactgtatctcagccactcactcacagggccacaaatctcaaatggccactcaactttgcccagctgtgctattattctgattgctttccatcctccaaatgactattttgtatcttatcttctccccttaaacctcctacccaaatattcctcctcactctttactaatcttgcgtcataccttatcttcattgagaaaaagtatcagtatcaggccgaaggtctcacctctgaccactgaatctacccatctatctgcatctctacccatacttgctgtctttcttcttaccagaaattatacgttcatgtggttgggtgcggtggctcacacctgtaatcccagcactgtgggaggccgaggcaggtgaatcacctgaggtcaggagttcaagaccagcctggccatggtaaaaccctatctctaccaaaaatacaaaaaattagccaggcatggtgtgttggtgtgcgcctgtaatcccagctactcaggaagctgaggcaggagaatcgcttgaacccgggaggcagaggttgcagtgagctgagattgctccattgcactgtagcctggacaacaagagccaaactctgtctcaaaaaaaaaaaaaaaaaaaggaaagtatatgtttatatgttcatgttcctacctaaggccaatacttctatatattccctggattccataccctctcattttctcaaagacttcactcctaaaatatacacactctctcttataccatcatttccacccccctctattggattattctcagtctaaatatgcttaagtgtccttatctttaagaacccttctttgaccatacatatttctctattacctccatttcttggctctctttcatagtaaaacatcttgagatgtctatagtactacgtcaatttctgcccagccagcagtactatgtcaatttcttgacaccacattttctctttattgtactagtcaaggcatataactacttaatgtttccaaaacccaatgcacagatctctttattttatttgacttctaagcatgattcagtactgttggccatgttttgtagtcttggctttttttttttttttttttaattgagatggggtttctccatgttggtcaggctggtctggaactcccgtcctcaggtgatccacccaccttagcctcccaaagtactgggattacaggcatgagccaccatgcccggccagtctcggcttttatgtcactgcactcttcagattttcttcctacttcattggctattcttccatctcttttgttggcttcttttcctctgctttacactagtcactgcaatgttatcggtgagcacacttgccctaggtagttttccatatgctggtgactcccaactttgcatctttggttccttgcactctgcacagagctgaagcctcaaattacctttgatttctaataagaatgtaaaaattaaggtaagcaaaataaaactcccccctcccaccgccctggctgctcctttttcttccttagtcttttccatttggtaaatggcacaatcatccacacaagctcaagacaaaaatttaggggctagaggtgactcctttttcatcacctctatattcaaaacatcacaaaatctgtaggctctgcccccaaaatagagctcacatacatctacttctctgctattttatcccaaacttgtcattcctctttggatttctgcaattatcttctgctatagatcttgctccccacccagtatgattcagtcatcacataataggcagaacaaacctttttacaatgtaaatcagatcctatcactccctccaactcactactggtttctctttacactttaaataaattccaaacttattccatgggtagatttccatggcctattcaaagccttacatgatttggcccctacctatccctccaagctcatcctgtaccactttctctacattttagcttcagtggtcttgatgatgttcctggaaggagccaagttctttccttccttagggctcttgcaattggagttgcctttacctgtagtgcgctgatcccaaatatttccatggttggtttttaaaaatatcactaagcaatcaatctaaactaacccctcccccagtcttaaggaagacctttacagttttacttcttcactgtgcttactattatccaaaattccttgctcatatagtttacctattttctatcttacactcactagaatttaaacttcataagaacagcgatcttgctagtctttcttaccattgtattcacaatgcctaaaacaacgcctgacaaagtaggatattctttaaaaaatacttaatgaatgcctttccctaagcaagtcacttgacttctctacttaactcacactggtgagtttactactgctagactaagctctggatccaggaaaaacaaaagtggctaaggtatggcttcttcagaagctcatccattcattccctcaaaaaatatttattgaacatatattacactatgttccaggtactattcaatctcagtgtttagtaaacaccacagtaacatgggatttggttaaccaacagaagtgtttaaacaggatgagtacaaaaataagtacaaaatgagaagtactataaaaacgatactttatatgttacaactatagcacccacctatttccttgtgtctagtaattggcaggaccttatgacaagagccaactgaaaaacagcagtataaattctggtactctaaaagcccagacttcaccactgtgcaatatatccacacaacaaaactgaacttgtactaactaaatctgtatagaattttaaaaagtaagttaaaaaaaattctggtactcacaggggacaatacctatgaatgcccttttcataggcacacagtgactaaaatatttggggcatgaattctctaggggtgacaataataagtgtcatttttcatgcttctgttgcacacataattatatttatctctaaggaaaatcagagagtggggtgtggcctccctcagtgccacctgggccagttgtctccccacatcaccaaatctgttatttcacaggctctaggacacccatagagggggagtgagggacctggtatggtcccgtgaagagctcttgtaacactactgattgatgtgacagacacagtatgtgtgcaactttcctttttccttcaaaagcactggtctaaagcagggatccccaacccctgggcagcagacaggtacaggtttgtggcctattaggaacaggccacacagcaggtgagcagggctagaggattatgcctgagctccagctcctgtcagatgagcaaaggcattagattctcataggagcacagacctgattatgaactgcgcatgtgagggatctaaattgcgccttctcaagagaatctaatgcctgatgatctgagatagaagagtgtcatcccatcttgccccccaccccaaactgtcttccatgaaactgatccctggtgccaaaaaggttggggactgctggaagtgcttgtcccctgggttaaagccaagaggagtaaacaggattaaggggcgtggatgtgggtgggtgggggaagagagctttctcaggatcggcaaccaatcccagaatctccagtcgcaggagcatgtatgtgaaggtttatttgcagggatccaccgtttgtaaaatagtacacgcttaataaaattaattttgaggtcaatcttaactgacagatctcttctttcttactggcgagtatttgtaaaataagaaaaacaggaggaaaagagaacaaacaagagagatgtgggatgacggagtaaggaaaggagtcacggagaggagagacaatgtctgtggctgttccctcagcgtctgggagaagagcccaagaatcccattgaactgagggggaggaaaggccctcctgcggcctaccgcaaggaaacgatcgcggcagacccgggactagcgccaaagggcttggaagggcggcgttaagaaaaatgggccgtacctacaacttctttcgcagccctcgctggcccgggagcggcccaggagcccagtgaccgttgcgtaagccacgcgccacccaggtgggcagggtggtgacgcgaaagcccggatagacttccgcgcaggggcggggcggggcgaggaggcggcagcgcgtttaagtgacgtcttggctgtccgcgccggcagaggcgagggttctggggtttctgggactgtctggtgtgttttctgtctattgaaccctttcctttcgacgtctcttctgaatattgactcatcgggttgtagaaatccagggacagagttgacatcactgggcattttagccaaaaagcagtgctcgggactgcatgtgccagaagtaaacttgtcaaaactcagattgtgtttcccctaaagtcagcttaaagtgcaatggtagaagagcacggtctctccccaagacggcctgagcttaaactgcagcgctgtcacttgctagctatgggacctaggcaaatacatcgtctccctgaggttgtcttctcatctgtaaaggacgctgtggtggtggtgtgagaataaatgagacatggcaagtgtctggaacaaagacgctgtgtacaaagtaaacacttaatatactgttatcagtataaaacctttgtgagttttttttttttttccgcatgaaatcttatgtggaaagttgtatgtgaaagaaatgaaagcggagctgcgttgatggtgggcccagaagctttggcctttcagtcccaaagtttccagtaatagaatccgcgcttcctataaaagacaaaaacaactgttattggagaaagtgtaaacttcttagaaagacaaactgccctttcctatctaatgtttctcctgacactcaatgtttactcttgaacactgtattcctttttgcctcagtgcgttctgtaaagttaattcctctaccggagtgttctttttcttagtcatcatctaagatctgatccaaattaccgttccttcttgggtaacttaaatacgaaattatctttttattggttttgttgacgttgttgagacagggtctcactctattaccccggctggagtgcagtgcgatctaggctccctgcagcctcctcctccttggttcaagcgatcctcctgcctcctgagtagctgggactacaggtgggcaccactacccccggctaatttttgtatttttagtagagaggagtttcacatattgcccaggaggacttgaactcctggacttaagtgatctgcccgtcttggcttcccacagtactgggattacaagcgtgagccaccacagccctgccctttttattgtttttaacaccttccctccttcaacgtgttatagacatctcagcaaggatttatttttcttcctcgtttcaggagagtagacagggtttcatgattatagggttaaggaaatgttttgtactcatgaaaaggaaatgttttgtactcacaggaaaagcaggtagatccctaaagataatgggagttgggacaaatggtaaacctgggaaggaagacctttgctaggagtctgtttgcctccaaggcactactcttatgctctagaaggaatgggctcctggagaggtaagtgctttagggtccatgtaaggaagatggagcgcacatcaacaaatggagttttggaattctcaccaggccagagggctcaggctggatttgagtcagtcaactataaatataatattacgtactccccaaatgccatgaagcaattcccacttgttacagagaggtacataaatgattcatataaaaatataatgttctgagacattaaaaaaatacagtggttctttgggagacaatataatgaaaatttactaataaaaaacatttaaacaatcatctgataacctttcttataaaaattaagttttaaaaataagtaaattgattatatttgcaacaaagtcatggaaagcaaaagcttttgaggaataaggagaatcttaactgagagcaattttttaaaactatacatgacatgataaaaaaagttttaacactttctacatagtttcatacttctgaaagtacttcaataaaaatatttagccaatgatctatttagtatgatttcagtgccaactttcttttctagtcttatctctaattctcttcatcaatctcaagtgccaatcactttctatgctccaggctttactgttttcaaaactttgctaatatgccagcctcccacactagttgttcccatcttcaccttactccctaatattaccccatccatccagatcctctccattcttgaaggtctagttcaagtatcagttcctctaagatttcctcaacttctacactaaaaacacttttgaattattcacttggattatagctatttgtacatatcttatttccttctaaggttcttaaaggcaagtatcatgtcttattcatatttgtattcctcacattgtcaattttccactagaatcaagttctattgaaaaccaagcccttgaatatcttgttcatcactgtattccctagtatctagcacaagacctggcacacagtaggcatgttataatatattctgagtgagggagtaaatggattttaaaacaagctccatgaaggcagggatttgtctgttttattcattgcaaaatgaatatctgaatataaacatgaaggcttagcattcattatatacaaaaaaattcttcaatctacatagcatcataaaagccaaatatgaaatacttatgttgcctttcacccaacaaattcagttgatgatatatctttctgaaaataatacatcccccaaaactgcagtacaattttaaagaaaaataaaatacatgtttatattagtttcagttttcttgtttgtatttttctgtgttctaaattttttgcaatgaaaatgtgttactttataatcagaaaaaaatactatttttaaagaatgtagtggatgagatcatttgcaaatgtttacctgaggaaattttgaggacatcaagatcaatcaaggtgattgggagttaataccagacagaaatatactgtccttggaaatatgacacttctttcagggactgaattatgtccttccccacacattcatatgttgaagccttaacttccaatgtgatgtatttagatatgaggatttgggaaggcaattagatttggatgaggtcatgagggtagggccctcatgctgtgattagagtacccttataagaagagacaccagagagcttgcttgctctctctcggcatcaagtgatgacacatgagtgagagggtgagaatgtggccattggcaagccagggagagagacttcaccagagcccaacaatgctggcatcctgatctcgaacttccaacctttaatagaagtaagtttctgttgtgtaagccacccagtgtatggtattttgttatagcagcccaagctgactaagatagactaagtggactaagatccgaactgtcgtgtggcaagtagttttctgatattgagagaggatcctcttcctctcagatttagtcagtaaatgtttattaaatgtctactgtgttccatgccctgtgaaaaatgctgaggattcaaggataattaagacaaggttcctacccatagggagctgatttaataagagacaaacatgtaaataaagtgaaaaaaagtgttacatgtgctctgacataagtatgtataagggacccaaaagttagagtaattgtttctatctgtggtttaagaggggataggttgagttggtcagtactctatcaggttaaccctaagttcaccaaccaagtcaagagatgtggctttcaatgtggtgacaaaccccggccttcacatggtgagccctgctgaatggtcagcctctgtcattcttgacctcaccatctccatgatatataacagcaacatagtcttatagcaattaataaattcctacaaagagcttccaggaataggcacaaatttcagagatccaatagaggaagtcaaaaagccagcactgggcagtcacagagatttagatggtggctaccctcttagaggtagaaaagagtttgctgcatgacctcaaaatgaaaacaggtattggcagtggcttcaggtgcccttcaatcatttctgtactctgtggacttccatttctaattttcctaggggccctaaacatattcaatagcattctgatttagttatactaactgtattatgtataagttaataaatattccaagcctgttacttggagaaaatgccactgatgacctgggaaacagcatgaagtgtaacactttttggtcttacatcccttttgctggctaagtcctaatcttccctcagccaatgccctactttctctgggaagctgtgcctaaactccaccacccttggattgattgagtgctcctgccatgagctccctagcagccctgtagttcctgcataatagcacttatcatattgttttgcaatgtcttgtttaactgtctgttttctctattggactgttaaatccttaaggacagggacaatattattcttgatgatgtgcctggatctcaaaagctttcagtaagtattttttggatgcatctacttttagagcctgcaaaaatagaggaccagatgatcattaagtttatggtgctcccagcaaagtgcacctaaccaatgaagttcagttcaaaacacttatctgacctttggtataaattaatcaagtccaaatcaagagcataaacattaaaggaatacagcaccatagggtaaccaaagcaaagttgacataaaattgaaggctatttagaagaagtgaatattaaactagttttgaatagaggtgaaagccatggtggatagggctcgaacagaagtctaatgaagagaggaatggacaggctttatttatgcagatcagcttggtgggattaggatattcataattcattcatctaatacatatttaatatctacttcaagattaaaatgaactttgaattctaggtcgaggagtttagataggatatgacaagtatgtaataaacacttcaggtacacagataacatgataaaaactgtaaactgtatgtgaatgtgattatttcagtaactacacagaagatgacctagagtgaagaggaacttatgagtgatacacaaaagcagagatggcctgttacaaagtaggataaaatatgacctatgcaggtaagtctttcttctaatattttctctgctggcaagtcacaatttctgaaatccctgccatagaagtcactcttttggtttaaggcaatgtctttcaaaagcttttgtttgcatgtaagaatatgctactgaatgatggtaacatccaacacagtggaagctctggccccgaaaatctgatgttccgttcctcctaggagtgtgaatgcttagctagagacaacacttagctgcctcacagccggatatgatcaataccaataaatgtaggaaaagagatgtgtccaacttccacatcacttcctcaaaaataaattgctatacttgcattttccttgagagatagaatggagatatggtagagatccatttttaacccatttatgcctagtgttccattattagaatgctaagcctgtgggagttatttatatcccactgctcaaggtcattgccaaggtctgatttttcacaaaaaatttttgcaacctctggcataaataggttaagccatgtcctaagctagggaatggcagagcttcaggacagaaagacatgggactctgagcagacctcataagcagagtaaccctgttggtattaacgaaccagccagtttcattagacagaaatagaattttattttcttttaagcactgtattttttatttcttcattatagcacattaccctaatgtaatattcataagactggcatagatttgaaacttacctatctcccacctagaaatgggaagagcctaaagatatgggtcataagaaacaaaaaaagggctggattagggcactccttaggggaaggtagactcacatgggccactgaaataaaggaacctgggtggtcagctagggggcaggataaagttttttgacatctggagggggcaagaggatgaaccaatgaagatacttcatgtactttaaaattttggtgggaccaatcagttacagtaattcaaagaaaggtagtaagggaaggagaaatggagaagaggcagattatcagggtaaatgatggtaaaaattaatgagagactgcattatgatgtttaacaacaaaaacagatccaaaaaagagagccaaaaccaattcaaggcatcagagcctgggcaaatatgaatcaggaaactgtgaaagttaaaagttagggcaatcctagctgaagaggatactgaagctggtctttcccacattaactgtaaactgtggtagtacattaaagtagatatgtccttatgcaaattaagatggatgatgaaggggtgtttgaaaaaaaaggcagagagattaaggttggtgatatagatcattaccacccacatggaaagagcaagggctaaaaatgctgtttaaagaaacagctacacttttggttctattacattttaagcttaaacattacatatttcaatatgcatcttgaaaaaagtagcagctttctaaacattatgttcagcactctctcttttcacctctaaacttgcacagaagtctctccttgaacttcttcatctttattttgatgttcaactttctgcagaagcctggggcccagtaaaccaataagcagacttccaattggggctgtgatgaggatggacaaaaatgccactgtcaacacatccattccatagtcttctaattgtttctctccatgtgaccttgctgtgtccaaagccacagatcctattgcagcctataaaagtttaagggtaaaaatggaatcatgataagataagcacatataaaaaaagtgagttttttattgtttgcaaaagcaaattgcttgttcttttgctcaactaagaaagttgtaagcatcaggagatatacctaatgctaaatgacgagttaatgggtgcagcacaccaacatggcacatgtatacatatataacaaacctgcacgttgtgcacatgtaccctaaaacttaaagtataataataataaaataaaaaaaaagaaagttgttttagtattctttcaaagtgtattgcaggttttgttttgttttgtttttttacttttttagagacagggtctcgctgtgttgcccagactggtcttgaactcctggcctcaagtgatcctccctccttagcctcccaagtgctgggattacaggtgtaagtcactgtgcccagcccagctggttctgatgatctaaaaactctgcccttgcatgggaacatactgatgactcatttgtacttatctgtgtaaggtagggttacataaatatcagtaaaatacatttcaaaacacaaagcaaatccagaatcacaatattaattaaatataacataaagttctatgtactaaatttttcctgaataaagatggaaattactggtcatctccttttatctttaggaatgtggaactaaaaaataagatgaaaaacatgcagtgatacctactgaaaactgttaaattttaaataaatatatattactttagagcttaaactcattgtcaaacgtcatgaaacatgaaaatagtggacaccttgacaacttgaagttgatcttattaggtatttggtcaactccttgccacagaatttggtgaaatgttttatttggaatgcatctgttggaaaacattatgaaaattctcagtttcttttagaggcaaaatgcaatattatcagtgcagatgggaaaaatgtattaattaatctggttatcccttattccacagagaacaatgtaagcctctaagacaatgaaaaagaaaaatgtgcatcagaaacaatggcagaaactactagttgctcacaaaaacatgaatgacccctttcccttctataatagaactcctggagtttggctggtcacattgctgtccagagacctttttatagaactcttagccattatgttttagacatttttgaaagtctgataggggtgaggggaattctggagtaatgcccaaatgcaaagagcataattgaaatctggaatataactgctgagcatacacatcccccaaagcctcctaaatgaaaaacacttgattttaattccttaataacagaaattggaatatttaattataaaataatctggggcaaaacagttaaatgttgtttgatgtaattagtctgaaaatatacaaccaaagatacatcacatttgcaacaaatcataatctatacagttctaacttaattagcaatcatagatattctaacaaatgcatggtcaacaaattcaagcacctatctataatagctttatttatcacgtttattagaatgcacaaattttcggttaagtgattgagacatttgccaggaagttcagtgagttttgaataattaataccaactaataatctaggaaatcaataaagtgctttctgagttgtttttcaataaatcttttctccattacatacaaagactctggtcaagctcaactgatcatcaatcatattaacattaaaatatctccaaacattaagggaaccatgttatttctattttactctcttcttggaagctattaacatgaaaagagttaagaactctttccttgggtgacttacagagtgccgactgatgaaaactcttctctcctgttactactgctttctagtagaatagggatttactggatttttacttataccctggtgatctaaggaaatttaatgagctatcacatttaaggaatgaatataccaaaaatacaggttttaaagaatagattaggataaactcttttcataaatccacttcaattatttattttcactaaatttaaacaagccctcttattcaatatttcaaggtgtcatgcagaaatagcagttaaaatgctaagccatcctatccatcatacctgaactgtggcctttggaagccatgcaaaagaaataaatatcttttcttttaagttaaaaccagcaaaacacaccatcagaaatgtagtcaaaattcgtatcaatactgcaatgcctacggtggcaacacaaaggcctgtaagaaatattcaatttttagaaataataaaatactaggagagaaactgcatctcatggttactaattcaaaataaccatcaacagaaataatttttaaagcattaaaaattacaaatacaaaaatgtttaggaagaatatataaaaacaatcaatattaaggatcaatcaggctatttgtttaaaataaggtgtttctgtagattaaaaccagaaattaagcatatttgaattcttatgtagagatttgaatgttatatatgtcttatgctttatagcaagaaccatgcttgttcatgtgtgtaagaagaatttattaaatgatatgattaaatgataagtaataagctttaaactaagtactgtgtacacataaatgtacaatgtatagactttgcctcaaagtcagagaaagacacataaacaaccaattcatagactatacagtaagtgaggtataaacaaactaagggcataaaagagggaaaaacaatattttaacccaaaaagtcaataattctttacagggtataagaccagaagtgatagctaaaatatttatgagccagtatggagggaattagccaatcagagctggctgggcactgaccaatcagaatagacactggcagtctaccactgtttcaccatactgatgtgtactggtcgtactggtcccaattatccctggttaacatacacagctactccatttagtcctgtagaattctttgctgataaagacaagttcatcatcatttgccaaacaagggattgtgagtagtgctgctacatgctactggacctaagaatgatacagctaaggtgactcctgagtattagggtgattttttaaaaagtaacatttgttgagtgtttactctgtgccaaatgctgtactaagctttaaatgtattattttacttagtccttacaacccgtggagtaagtattattttatagttgaaaaaaccagaagctcagaaaggataagtagttttctcaaattcaaagggcgggtaaaacatcagacagacatagcgggaggatctattgtaaatctgccatatggcttttttatgggaaagttttgtggttctttgttgaaaggtatttcttcaaggttggaaagtattcaaaaatatctgtagcctgaagtacaagataaagagttgatatcattcccagaaggaaacattgaaagtttgagaagaggatgagaaggaagttttagttgagtttgaacgttaacaggacatacaagtggtgctgtccaatcaacaattggatatattgatttagagataaatagtttggaattatacagtttatagttgatgtcactagtatagataaggttagagaagttatatagagccagaggcacaaagttagaaagcaatttgataaagggcagcatttaagctacatatggtgtaaggaaaggctcaaacagcactgggaaataggaagtttaagaacttaatataaaggagtgttagagggtcaaaagcagcaaatgctgctgacagatcaagtaaagcaaagactggatttagcaatattaccttggtgagaggctggcaggttgtgtgagaggttggcaggttgtgtgataggcagaagctgggctaaaatgtatagaaggaggaaatgggaactgaagtggaaaggggaatgtagtgacctcttttgaaaagtccgaaaagaagacaagagaggtagcatggtagagacggggggaagtgaaatagaggaattttatatatatataattttaacatattattttaatatacattattttaattgtagtaaaatacacataacatttaccatcttaaccatttttatgtgtatagttagtatcattaagtatattcacactattatgcaaccaatctccagaattttttcatctcacagaatttaaactctatacccattaaacaacaatttccctttactcccagcccctggcaagtaccatttatgagtctgactactctggatacctcatgtaagtggaatcatacagggttagtctttttctgactggcttatttcgcttagcataatgttctcaaggttcatccatgttgcagcatgtgtcagaagagaagcatttttttttaagataagagagattggagactaaattctgaagagaagaaaattgcgacatggatatttaagatgtatgagaaaaggaaagaatccatatgcaagattcagaaggagtagcgggagatgggattcctagtatggatggaagaatactgtgatggaaggaaagaaggaaataatgagtacatatatacaaattaatttttaagtgcagtgttttgaatcaacagagttttaatatgatggcttttgaatgtaggaataaataaaataattaatgaacaacaaggcatttctatcccatgggtacaaactatagaactaactagttgtctttaaaattctcgctcttgttcaggacaaggctagatgaatattcttacccttggaaaaagaattgttaaggcctgaattttctgggtagtggtcagcagtgtcactttcatatacaaggaacaatattaaatgtgtaaaatataccatcttagatgaacaagcattattttctaaccaactactctaaaaaacttacatcataattaactttttatataattgtgacaatagtaaccactgtacacatacctgctggagatatttcaatgaatataaaaagtagactttattggtgagtaggctgaccaaaaaaagtgaattttaacaaaagcacattttgaaattcttacctacagtttctggtctgagagatgcaatagatacctctgctccaattagtccaaaaagaaggggctgaaaaatgtcccaggcaactgcaattatcttttcaacctctgcctaaaataacaataaaacacacacagatttttattatgtgaagttacaaatgcaaagaattttattaatttgaggtttgaattatttggcctgagataagctttatttctgtgccatctataactaaaaggttagctagaacagagcaaaaaaactgcatgaagatctttctatcacagttaagatacatgaggtgttttagcatactaaatattagtttgcacatggatattaataaaaagattcttataaagtaatcttatgaggactcctacttctgaatacatcgtgtgtatgtgcatgtgtgtatacatattgtaatatatagtagtgttttgtagtttaaaattttatgtcgactttccttcaacaatatgatttagagagcttgcaatattggtacatatatctagatatgcccctattactgctgcatagtgatctacagtatagaagtaccatagtttattcaatcatttctttattgacagatctttaaattgtttccaattttatctgtacaaaaaatactgtttaaggttatctcaaatcacgcacaaaaataaaatccaggtttactaaagtgattatcagtgccaattatcactttattgcccattatctccagctcctctttcactgttgctccacagaaaatggagctgggcctttaaaatatttttcctttgccaggtagcaccatgttaaactttgtcagtagagtgtgctaaagagatattgcaagctgaaggtgcttttcttcctggtttctgtggctcttcctagcaagatcttatagcatgcactggtggccttagctctaggttcctgcatcccaggtggcttctccagtatcagggtcctacaattcatgcaaccagcagcacctagtggccattacattccctagcatacccctggggcagtttcgtagcagattctcttgagcaagatacttccccatgcacccaaggggatggatctcctgcaaattgggagggtagattttcagcaaattctgcaagcacagcaccacagcgacttctctaggctctaacagagtctggatctcagccctgcaggcaggaatgtggagggtacaggcttaaggggatgatctattatagccataggtgctattctcatattctttaaggatgtcttcacatcttactagccaataccttgttactggaatccctggtgtggttaataatcaacttttcctattccagttactatttgatttctctttcctcataggaccctaattgatacaagaactaactttgtaacacataatgcaaaagactctaggaaaacagtgacacaattgactagagtaacatcaaaatgttttgtggcaaaagaagccataaaccaaaaaagtgacaaactagaagaaaatatctgtaccatgtgtaacagaataagaaacattggccaatcaataaaaaaaagacatagatcctaacagaaaaatgggcaatgaacccagagacagcatcatcatactgaataggcaaaagctggaagcattccttttgagaaccagaataagacaaggatgcccactttcaccactcctatttaaccggagtactggaagtcctagcaagagcaatcaggcaagagaaagaaagaaaaggcatccaattaggaagagaggaagtcaaactatttctcttcgcagattatactatacctggaaatactataccaagaatagtacagagatactatacctagaaaacttcatagtctctgctcagaggcttctagatcttataaacaacttcagcaaagttttaggataaaaaatcaatgcacaaaaatcattatttctatacacaaataacgtacaagctgagagccaaatcaagaacgtgatctcattcacaatcgccaaaagaagaacaaaatatctaggaatacagctaaccagggaggtaaaaaatctctacaatgagaattacaaaacactgctgaaagaaatcagagatgacccaaatggaaaaacataccatgctcatggataggaagaatcaatattgttaaaatggccatattgtccaaggctatttatagattcaatgatattcctatcaaactaccaatgacatttttcacagaattagaaaaaacattataaaattcatttggagccaaaaaagagcccgaatagccaaaagcaatcctaagcaaaaggagcaaatccagggatatcacactacccgacttcaaactataccacaaggctacagtaactaaaacagatggtactagtacaaaaacagacacatagacaaatagaacaggttagataatccagaaacaaaactgcacacctacaaccatgtgatcttcgataaagctgacaaaaacaagcaactggtaaaggaccccctattcaataaactgtgctgggataactggctaaccatatgcagaagattgacgctggaccccttccttacaacgtatacaaaaataaatttaagatgaatgaaagacttaaatgtaaaaccgaaaactacaaagcccctagaagatctaggaaataccaatctggacattggcccaggcaaagacttcaagatgaagactccaaaagcaattgtgacaaaacaaaaaattgacaaatgggaccttcttaaactaaagagctctgcacagcagaagatactatcaatggagtaaacagacaacctttagaacaggagaaaatatctgcaaaccatgcatctgacaaaggtctaatgtccagaatctttaagaaactcaaacaaatcaacaagcaagaaacaaacaactccattaaaaaatgggcaaagcacatgaacggacacttctcaaaaggacacatacatgtagccaacaagcatataaaaatgttcaacatcactaatcaatggggaaatgcaaatcaaaaccaaaatgagacaccatctcacatcagtcaggatggctattattattttttttaatatttaaaattaaccacaatatttgagcttgtggaagtaaactgggtgaccaaatgtcaaaggaaacataattgtacatcttttgatactttttaattttttgaatatttgagcttgtggaagtaaactgcgtgaccaaatgtcaaatgaaacataattgtacatcttttgatactttttaattttttgaaaaaatttattttaaattcaggggcacatgtgcaggtttgttacataggtaaacttgtgttatggcagtttgttgtacagattatttcatcactctggtattaagcccagtacccattagttatatttttcctggtcctctccctcctcccaccctccaccctacaataggccccagtgtgtgttgttctcctctatgtgtccatgtgttctcatcatttagctcccacttataagtgaaaacgtggtatttggttttctgtttctgtgttagtttgctaaggataatggccacccactccatctatgtccctgaaaaggacatgatcttcttttttatggctgcatagtattcgatggggtatatatacaccacattttctttattcaatgtatcattaatgggcatttatgttgatttcatgtctttactattgtgaatagtgttgcaatgaacatactcatgaatgtgtctttataacagaatgatttatattcctttgggtatatacccagtaataggattgctgagtcaaatgcatttctgtctttaggtgtttgagtaatcaccacactgtcttccacaatggttgaattaatttacacttccaccaacagaatggctattattaagtcaaaaaataacagatgatggtgaggttgtggagaaaagggaatgctgatacactgctggtgggaatgtaagttagttcagccactgtggaaagcagtctggagatttctcaaataaatagaactaccatttgacacagccattccattactggttatatacccaaaggaatagaaatcaccctaccattaagacacatgaacgtgtacgttcattaaagtgttattcacaatagcaaagacacggaatcaacctacatgcccatcaacggtagactagataaagaaaatgtggtacatatacaccatagaatactatgcagatatgaaaaatgaaaaaagctggaggcatctcactacttgaattcaaactatactacaaggctacagtaactaaaacagcaatggtactggtactaagacagacacatgaaccaaaacaacaggctagagaacacagaaataaagctgcacccctacaatcatctgatatgtcacaaagccaacaagaacaagcaatgtggcaaggactcatatataccatgtacatatataccatggaataccatgcagtcataaaaaataatgaaatcatgtcctttgcagtgacatcgatggagctggaggccataatcctaagctaattaatgcaggaacagaaaaccaaataccacagttatcacttacaagtgggagctaaacagtgagtccacagggacacaaagaagggcatgataaacactgcggcctattttaaagtggagggtggcaggagggggaggattgaaaatagtatgctgattacctgggtgacaaaattgtctgtactccaagcccttgcaacacatcatttatccatgtaacaaacctgcacatgtaccccttgaacctaaaataaaagctgaaaagaaaaaaaaaagaaacatgggcaaaacatatgcacaactaattcacagaagaagagatacaaatagtcacaaaatctaagacactaaaacggagtaattatgaaacacaaattaaattgacatgccttttttttttttcaagggggaacaccacattggaaaaatactaaaaggttttaataatgaaaagtattcatgactttgtaaggaaactcaccatttggcaggacaacaaattgataatgcttttttggagggcaattgagcagtacctattatactgtctaagaatttacatagaacagattttctcataactgaaaagaagctatatttttggatgacatttcaatgcttacaattacacaatttaaggatctgcaatatatacaccaggtcctcaaataatgtcgtttctttcaatgttgtttccttccaacaatgaaaaaaaaatcaattcttcatgttctccccatatctgcaagcattttatgtgggtaatctggtttcctcccaaatcccaaagatgttctcattaggtgaactgatgtgtctacatggtccctatctgaatgactgtgggtgtgtgtgaatgcaccctgtgatgggatggcatcctgtgtagggttggtgcctgggataggctcgggcttattatcttacttgtttttattaacctttctgaaatgtatgtgtagattacaattatttcaatgtttaatcttcacagtgttttggtttttattcagaagtttggtgatgtttttgtgaccagaaatatgcgttaggaacttagctcttgtttataccaattggcctatggtaaaattggttttgttatttgtcttttcacttaaagttgcagcttctgagaacctattgacaatgctaaaatgaggacttactattaatatattcagcagtttgacaaagaaggattacaatgtttctttgtattctttatttgcattatttctgatgtgtttatagtgggaagattatatttccattcagcttacaagtgttgaaagagagcatatgtgagggcattggttgatttatttaatagttctgtttctatagcatgaaaaatattatgttttcatcagataacgagttaagtttgaaccctccaccactaactgcaaggcacttgcctctcagcacctcactttctcatgtgtagaacaaaaggtttatattagataacatctaagatcatttattatgtaatggctagttctgccaaaactacgatccagttaacatccttccacatatctttaaattttactttttaatttagttttttgagtatattatagctaaaggtaagactttttttttttttttgaggcagagtcttgctatgtcacccaggctagagtgcagtggtgtgatcttggctcatggcaaccttcatctcctgggttcaagtgagtctcctgcctcagtttcctgagtaggctgggactacaggtgtgcaccaccacacccggggaagttttgtatttttagtagagatgaggttttgtcatgttgcctaggctggtctcaaactccagagctcaggcaatctgcctgcctcagcctccaaagtgctgggattacaggtgtgagccactgcacccagccaacgtaagactttagttgatactcattgtagtaaagaacaagaatcaactctattaattttagattacttagacttttgttgccatgaataattgtttaagagaagtcctcaaatgtgtttcatatactcagaatacaaatgaaagtaggactaaaaatatttctaatcaaattattttttatttctaaactgtagacaaaggccaaaatttgtttttgattataacactttagactagttgaacatcagacatgggcttatatattgcaaaacatagaaaaacatagaaaagtcacaatgtatcttcttgtgggtttttcataatgtcaaaactaaaatgaatttgcctataaagaaaatggagtcattgaataggctgtgtataaaagataagcccagggtaatgaagactgtgttgtcccttgaaaattaaggccatttgacacatttgtatgcatcattagtaagaatctgaaaaaatatcaattactttggaggaccaacaaaggagaaagttaagataaatggaagtttcatcatgagttggatatctacttaagtttatacttttttgaaagaacattttaagattcagaaaatccaaaataccgtatcaacaaaaaaatctgtaaaagtcattagaagcagcactagatttgacaacagacaaaaaaagagaagcagctttaaaaaaggtgagtgcatctgaatacaacaaacaaatggaaagattaatgcttataagaccaagcacaaagtataaaataatatcagaaaactatggacacaaacagaatcttataaaatattttagcttttcaaagtctaataagttaacaacaatattgctacagccctgtagaatttacaagtgtgtcattttcattttctcacataatagttacagcaattttttagatgattattgtattcactttagagttgagaaaactgagtatttcagaaggcaaatgacttgcttgggattatacagctagaaagtagtagaactgggattggcatcccaatctccatattttaaatcttatgctcttagtatgatatcatgctgttctggaggtaattataaaaataataagagttattatttactgaatgtgttctatgattaataactttccttagtgcttcgtacaggttattttaccgaatcctccagtcagtgaagttgtcatcatcactgggaagttagataacttgcacatggtcagacacacctagtaaaagctgtagtgttgagactggcctgaggagtctgagctcttggccctaggctatcctttagaataaggtaagaaaaggaatccaaactcaggactttggtttggttcctacaggaataagaactttcctgagtactaaattagaaaagatatggagagtacctgccacacgacagagtcaataaacattacttttccttcctttttttggggaaccatttttatatattcaaatggtatattcttttttttttttttttgagatggagtctcggtctgtcgcccagggtggagtgcaatggtgtgatctgggctcactgcaacctccgcctgccaggttcaagcaattctctgcctcagcctcccgagtagctgggactataggcgcataccaccatgcccggctaattttttgtatttttagtagagatggggtttcaccatgctggccaggctggtctcgaattcctgacctcatgatccgcccacttcgttctcccaaagtgctgggattacaggtgtgagccaccgcacccagcctcaaatggtatattcttatcctggctctgtcacttactttttgtccttatttttgaccttcgcaatatacttagtatttgtaggccttggtttcctgattttaaaagttgctctaatgtttacctttcaagattattgttaagaataaataacatatatctcactaacaaagagctcttcaaaaaaattaaaactattataggagactgacagatctgactacatgaaaatataaaatatctaagtgttaaaagtgaacaatataaaaaggtacaaagattacttagacttctgttgctgggactaattgtttaacagaagtcctcaaatgtatttcatacactcagaatagtaatgaaagtagaaggactaaaaagatttctatatcaaattattttttatttctaaagtgtagacaaaggccacaatttgtattttgattataatgcttcagactagttgaacatcagacatgggcttatatattgcaaaacacagaaaaacagaaaagttacaacgtatcttcttgtgggtttttcataatgccaaaactaaaatgaatttgcctataaacaaaatggagtcattgaataggctgtgtataaaagataagcccagggtaatcaagactgtgtcatcacttatatagatgtgtgtattgggggtgtatcttacagatggataatcaacacacattatactttggaagataatgaacaaaagacctaccaaagaaaaagaaaaaacacacaagtgtctaaatatgtgaaaaactgttcaatttcactgttaaagaaacacaaaataaacaagatgcaactttttacctatcagtatggctaaagattaaaagcaataatattttaagccagtggttcacagtgtggtccctagactggcagcatcagcctcatctggaaattaattacgtgcaaattctcaagccccaccacagtctaaaatcagaaatttgtagtagggcccagaactcaaatttaacaatccttctaggtaattctgctaaagtttgagaaaactattctaaggtgaagttgtaatgagacaggtacttcatattttactggtagaaaagtaaatggatagaactctagaaagcagtctggtaatatgtgtcgaaaacctcaaaatgttcatattatttcacccccaaattttactgttaggaatattccttaaggaagtgatcaatttctgatcatttcagcataatttaaaatagcagagactggaaataaccttataactatatataaaggaatgggtaaaaaaaccaaaaacccaactatggtgcatccatgtgtgtagataaagagattcacatagcagagttactagaggtaaatatttttaaaaatgttaatagttatctttctggttgtggggttacactgaccttctacatagcaggactacaggaaatgtaaacaaagggaacaatggtttggtttataagaatcatttatagataaccacattatagtttctctgaataacagtgtaatcggaagtgatcagtttccctttccctcctttttctttctgtgctcttatccagtgcccacttgcaggaggtatcagtctctccttcatttctctgttgctaaaactacttttttatgctctgtttcaaatgatattgctccttctcattgtttattctttttatcctatcatttatgaatttagaagctgaattttaaactgcaaaagtttagaattatgtttaaatacacatggtaagtgttactcaaacagatgtcaaaatataaaattgtgtcatgcacaataatgctacagttgtactacagcatagtacaactcaccttggagtcaaattaatctgagcttaaatctccgtgccattttctaattgtgtgaccttggacatgttatttaagtctttctgacttacagcttctataaggtagaaatcataatacttttcaaaggtaattttgtgaaaataaatgaccatatccacttagtgcctcatacagagccatacagcgtagcaacaaaaatttattaattcctttttctctttttacccatgacagtataatataatgagttgatttcaatttgcaaagatttttaaagagctggtgacagaatgcatttctgttacactgttgatatgagaatgaatgttatttacccacagtgaatgctgtctatggaagatccccacagagatccacttaattgagttatgattatatatctcatctcaaaatttgtaacgtttccatattttccatatggcattattttaattatttaagtttaattattttgaacagttgtcttcaggctttgtaagattatcacaaaatgatatagctgcatttattttaggtcaccgacatcttcattaagcagaatagcatacaatcctatcaagttcaaatctacaaaaatgaatctgaaaattaaaataaataaatgacaactagtgaacttccataatacatataaaccaaatgaatattcttaataatcttgaaaatcagtatgaaaaaccaaagcaaccttataaaaatggcaaaggcttttgaacaaactgggtagtaatcatatgaaaacatgattagcattgcccataaagaaatgaaaatcagaataataatgagatatatttttaattcataatatcagcaaaatatctcaaagacttagatcagaaaaacagatcctctcacataatattggtaaaaatataaattggtacagtcttttaaaaggtcatattgatattatcaaaagtataaatgtgagtactctttcctagagcaatctgatttctagaaatttattgtataaactaaaatatatactatattttatttattttaagacacatatttttatattttaacatttctgaaattagaatgttatgttatcgtttaattggcactattttttttctttcttggtgtcatataaaataattgtgttttttagaattgacagactcagatgaaatatggtatgtaaggatatattattgaagcactgtttatcttggcagaaaactagaaacaacgtaaatatctataaaatgcaatactccgtagccattacaaagaataaggaaggcattacggtagtatgaccatgatatattttaagtaaagacatcaagttatagattgatgtgtaaggggaaaaaaaagatgaacactgggtgtacatttgtatatgcacattaagatagcttttataatgaaatactttattaatttgatgctaagaaagtatctggaaagccaacttaatctcattagaaaagagtcatgagcagaaaaacttaaaatgaaattcaccttttcgctggtccatcccatgcctgcaaggaaagccatgaccaacgtgcacagtcctcctgatccagggaaaccaaaatgcacactgctgaacacagctagcacagacaaccccaacacaaggaatgttctcttacacacaagtttgtcctttaggagaaaaaaattcatttgctcaattatttcaaatccctgatttttaatgattgattttttccatatctaggatttagaaagaaaataaaaattaaaatgtctatataaatagacaaaacaagtgcactacataacatttactttctcttcttaaacaaaagcagagttagcacactgcaatggtgagctcttctttcaggaacaccaattctctcctctacagttatcaatgcagaatttcacagcacttaatgaagtagcagaaaaaaagtacatgagctttggagctggacagaccaaggttaaatttatagtttttatacattgttggtgtatgtagtagccacattacttaaccactccaagctttgtttcctgaaagcatttacatcatagggtttgtgtgaaggttaaatatatatctctattattttcaggctctatgtttactgttttaaatttgacgcccccttggtttttctttctaaatctttggaaaccaggaagctttaagaggttctagactgacagtagtttttgttgctgttgttttaaagtctaagaattgtgtactttttttccctttacttttccctgtccaggcttttaaacttcttgatcactttagaaagtaggtctttaaaagtgcttgacttggcaaaggcatgcaagctctgaaggtgaattacctgagttcattcccagttccaccgctttctagctatgtgaccttgttcaagtcacttatcctgcctaagcctcaatttccttatcagtaaaatggtcatagtaatagaaatctctttatgaactattttgtcggttgtactagagcagtgttttccaatagaatgtttagtgatgatggaaatgttctgtatctgctatagccacgtgtagctagtggctactgtactgaacaaagtggcactagatgatgattgactgatttatgtatgtgtgtatgcatgtatgtattagatatgggctcttgctgtgttgcccagactggactcaaactcccagagggatccttttgcctcagcctcctgagtggctgggactaccaggcctggctagaatctaaggtattttgatactaaaaaagggcacaaaaaagctattatatatctgggtttagttgagtattatgaacacttaaaaaacttgcatatcctattactttggaacgatattatttgttttacagtggaatttgaaatgtacagaatataatacgggaacccattacaggactgcattaaaatcttctatattgagcccacttcataaatctcatggatagcagtaagcaattttaaaatgaggaaccatttgctcaaacatgtccttcacatctgtctttgaaggaagtgttctagaatgttttcccaatgatatttcagagcacaactttcccacatattatttctttcacctggtcacggcttggaaagtactgaatgaaaaatccaagaacagatccagttgccacaccaattaccacctccaaaactcctctgaggacattaaagacagtagagcctgaaaaatatattaaaaaaacttagagctctaaatccaacaaatacacaggttttattccacaatcatcaacatgaagcatctaattacaaagaagaaacattttaaagacagtttctgctttccatattcttaaatatgtaagtggaacctacattttcccccatagcatataggatttaggaaactttaattaaaaaaaattttttgttagcacattgtgcagaaaattatattaaagtttctccacacataaagcacttcttcacagactgtcctaagaaaaatgtactaactggtttctgtggtctcttgttattatggcaatcattcttcttatctaaataaaattacctctgaagtaattttatttagctaggatcgctttctaccaggtaatgctatgactgttaaaaacatctagttgtgatagtagcattatgcttaagctattgtggtaataatttactatgaatgtgtagaaagtagctaattagctttagtctctggtatattgaggtgattaaaaaaaaaaagtcttgggccccacccctaaaaatctgattcagtaagtctagcagggctcagatccaaaaggtctaaggaccacacgtagttggtgggggggtggggcggggagaggaaacacagcagagtcaactaggaaggttcttcgagctgtagcttatgaaaaccccactgcctctttcctttctcctcccaccaccatgattctaatgcaaactctgttgctctaaagctgtggttcctattccaagctgcactggtttccactccaaaaggttctgatttaattgtctaagataggacctacataagagtatttttaaaaatcgcccaggtaattctagtgtgatggtaaggctgagaacaattgttttaaaggtatataccaggaaagtggtaagaacataaatttgggtatgtgtagtagcattaaaaataggagtatgaatttgacttaataggtaagagagcatcctcaaaggttcttgaacaagaaagtaatgtaatgaaaacaatgttttaagaaaatcaatttactagggaatggatggaaggcaggctctggagcaatgagacagggtgggattctaggtaacaggcataaatcatacacaatcacagaatggggagataactatagggagataacgagaatgtataacctgccaagaagatgtgttcccactacagaatctaaagctaaacttagattacaattatactttgtcaatcatataatgttgcaaattttatatcccaattttgaacataagattaagaaatgaacttaaacttgtgctgtaccacaggataataaaagtgttgaactgcttttggccttttggctaagatcaagcgtactatctgttcacatcagtttaatataggtgttgaacaacagtgggagaaaaaataacttaagttcctcttttactatacttgaaacaaaatacctcaatttcagacacttactaagtattaatgggacatccattaaaatcattgctgttattacccataaaaagctgaagaggagagaagagaaatttttcttattttaaaggcatgctgttcctttcacttggactgctctctgtcatttgtgctccttgaaaaacccactcatattttgtgtgaagtctccacacatcttttgtgtgaagtctccacacatcttttgtgtgaagtctccacacatcttttgtgtgaagtctccacacatcttttgtgtgaagcctgaacgttcctggatcacttcaagcagaaactgttctttaaatctttctaccttctaccgcccctgccgtactgcacctactgcatgctacttgagcagtctctagagggagcaagagagtaaagacagacagcttctggaccctccttaggtacagaactcttagtgttcttttgcctatttttaatttgccttaatcaattatcaagcaaatatgtcatgcttataacattttaacctacgtccctagaatgcaagagtaaagcctgttgtgaactgattaggttacctgtggaaaaggctatgcccaagcatgtgttgaagccagtgatggccagaatgtcatcgaagctgccagctgccatgagcaaggttgggacacccttctcaacaccatagcctcctccctgcaaaaggagcattgaaggcaccacaacagctggagatacagcacctaaaacaaaactaggcagacagcattttaaacatttatgataacatcttacttattactattttgaaattataatgccctccactttttaggggttatacttggacaacaacagtctttctttttttttttctaaattaagaaaacaaactttaataagaattgttttttgtttttttttcttttttttattatactttaagttttagggtacatgtgtacaacgtgcaggtttgttacatatgtatacatgtgccatgttgttctgctgcacccattaactcgtcatttaacatcaggtatatctcctaatgctatccctccccccctccccccaccccacaacaggccctggtgtgtgatgttccccttcctgtgtccatgtgttctcattgttcatttcccacctatgagtgagaacatgtggtgtttggttttttgtccttgcgatagtttgctgagaatgatggtttccagcttcatccatgtccctacagaggacatgaactcatccttttttatggctgcgtagtattccatggtgtatatgtgccacattttcttaatccagtctatcattgacaactacagtctttcaaatggcagagaagcatgaatccagaaaaacatgtatgtgtaaaacttctacagaacactgtttttcaaaatgtagccatagacaacttgcttcagactacttaggttgcctaaaaagatatatttattagtggtatagaaggcctaatgagggtaggccccaggatgctggcttttttaaacaaaaaaattcatgttataaggtttgaaaatgcatggactttctgatttggaacccagtgatgctaggccttctattagggcttgctatgtcaaataaggcaacagattagaagaaaacgatatgacagtcacattgataccagtaacaacagcagtggtaacagcagaaagcattttacagtatttactatgtaccagacaccattttgagcactttacacgtattcactaatttaatcctcacaacaaccctataaaatagacaaaatctatcttaattttataattgaggaaactgaggcacagagagattaaatacttgttaaagatcacacaccggaaaaatcacaaggctgggatttgaatccagggagtagagttccagagacttaaccatgagaagaatttcttacttcttgcctcttattagcactaaattcttactaagtcctgtcttatttatttactttgtgtggctcttaactgttggaagtaaagaactgacagtggaacgaagagacagcagaactgccaagtcataatagtctggtgacaggaggaaaacaatagtagctgttgatcactgttgctgtgtttattatcctttgtgcagacgttaggtggaatccggtatctctttaacaggcattgaatcaggtgtaggcaaaagaccacgacttcttcaacagtttgaatagtaggtgctaactgtaagagttagcgcctattaacacataaactatgttttgaagttagaatatttaaattatgctgtaacatctatgttgcattttctgatatctataagaaaattctattatgcattctcttgtatgcaatcagggaaagccctaaatgtccctacatattttcatatgacaaagaaacaatcattaccccagtataaatccccattgccatggtaaacccagcaggtaatgggcaagaagagcagatgtgcacgcctccacaatacagggacccatggacagtcttacacaaacgccctttaacttcttcagggcctgaaatagaaaagtagacatcctaatataatcctctgaagatgtgcagagaagatgaccttgaatgctttctcttcagtatatggaccacgtctgggtcatcatgagttttcaaggtaatgagttgtatttaacaaacattttagcactccaagtgttttcagacagcttattaagtcctcactgcaaccttataagataggtaatactattattatccccatatttttagatgtcctcatctgaaaaggcacaggctaaaggcatttgcccaagatcatgaaactggtgagtgatggggccaggtttgaacccaggcaggctgctttcagcatctgtgttcataatctctagctaatttaacattctcattagttttatttataatttgtggtcccagaatgagactaaagtgaagagcctgatcccccaagaaaattcattcctgtattcaaaaacatacatgaaaaaaaagcattaaaaaggcatacttgaccctcattttatatattaggcagtttcctgagctagtatagttagccctgaacacttgtatagggctttgcaaaccaaaaatatgttgttttctcccctgtgagcattatttataaccctggtctatatgtacatcagagaaaagtggggcctttattcttggtgctggccccatagacagactctacctttctccaaggaagagaatgagaccggctgggcgcagtggctcatgcctgtaatcctagcactttgggagggggaagcaggcagatcacctgaggtcaggagtttgagaccagcctggccaacatggcaaaaccccgtctctactaaaaatacaaaaattagccgggtgtggtagtgcatgtctgtaatcccacctacttgggaggcctgaggcaggagaatcacttgaacccgggagacagaggttgcagtgagctgagatcaagccgctgtactccagcctgggtgacagagcgagactctgtctcaaaaaaaaaaaaaaaggaagaaaatgagaccaccttttgagttattgcaaaccacaacaaggtctcacttgcaaaacaatcctccatgaaataaattctattttattctcaagaatgtcatgcaaagtgtccacatccatttcctaatgcttagtgattctgttagatacctgaagcattgaagaaacaagattcctatttaataatgagaaatttacatttcatacctttgaatccagaccaaggccagcacgaaccagaatgatagacagggctatgcttctcaaagaggaagaccacttgtgcttgatctgcacattatcgttgatgactgggatatttctgatgagaaaccctgcaagcagcatgccttgaacgaagaaatcaaacatatctagttagttttcaaatacagaaaatatttttagtactttaattttatacagactactatataatcccaggaaccacttcacttatgcttagaagaaattaagttaaacttttaagtaaaaattagtataataaagcagctaagaaaataatgtacagataaaaagatagattataataattaatattcccaaaataactgaacttaaaagggagacaagatgcagcatttggatagagagtatgatcaaattctaaatataaaatgttttaatacaatgccagctcagtcagccctttgcgtgcaaacagcaaacagcgcatgaaattatttgctatgtcagattacttgaaatatcaataaatacttatatggattctattttaccttcagattagataatttcataagagacagataatctactttgcaaaggttttagatgtcaattatgatgaaatggacattgccctgtcatgtcagctggtgactcttctttcactcagtcattcaactgtactgaatgccttcagtagtttagacactagagtatgtatcacacatataataatggattacatttcaacaagctttcagcctctagggaacaagacaaacggacaataccaattttatgaaggcatgagggggatgttacatgagctgaggcaggaagggggatttagagaagggggaagaggatgaagaaacggctaggggagttgagaagtttctggaaaagacagtagtttattcaaaggtaaaagaaaaagtgactcattctgaaaactgcaagtagttgagtgtaactgaggaagctgagtagttagtgagggaattctgccttcattgataccacatgcccacacaaagggaaaggtttctgtgagagactgagcctcttccctccatgcttctccagcagtgccctcttctcaccttgtccctataagcaccacacttcaaacaactaaataaatttactgaagttaggttattttgtgatgcaagatgggagaagagagacaacctgctgcacatgaaagcatcactccaggtatctctcatcactgccatttatctacgggaaagtctcgtaagttctgaatgctgtggcagtggtctttctggaatgtttattgggcaacaatatgaacaggcttggtttttggaagaaataatgatgagttatatatgcacatggtaaaattaagacattgctgacaaaatgtaaagtgacaagtacatactgtaccccaactgcaaccttccatcttcattcctgaatgtatttcactgttaagggtcttctgtgcccttccagaaagtttctgtacctattcaagtatatttctgtgtgtataagctcttttgtgctggacacaaataggacacttatacactgctgtacggcttgggtttttttcccatttaataatatatcctggacattttcccactgaagcacatatatatttgctttattctcttttaataactggaatagtatctcactgtttggaagttccataatttttggaccactaataatagattttaagaaacttttcaggtttttcattataaacagtgctgaaatgagcacaattcatacatcaagtatttaagtgcctgctacatgctagccctgtatgagatcctagtaacaaagaggtgagctagaccagcagtccacagcctttttggcaccagggaccggtgtcgtggaagacgatttttccactgatggcagggggaatggtttcaggatgaagctttccacctcagatcatcaggcattaattagattctcataaggagcacacaacctagattccttgaatgtgcagttcacaatagaactcatgctcctatgagaatctaatgtcactgctgatctgacaagaggcagagctcaggcagtaatgctcgctcacctcctgccacggcccggggcttgggcacccatgagctagactaatgtggtccttgtccatatggagcttatatatttgtaggtttacattaactatattcatattataatttcaagcagtggaaatgttaggccctatggtataggtatatgtcatttttatatatattgatagcttaacagccaaaaatactgcactaatgcttacattccattatcattacaatagctctttaatgaaatttaaaatgtgtttctaagccactcctaaattaacaatggcattcaatgacctgaaatcaaatggaatatcctaagaagaactcaaaactatgttaagaggtttttttgttttgggggatatgaggggacatttttttttttttttgagacagggtcttgatatgttgcccaggttggtctcaaactcctgggctcaagcgattcacccaccttagactcccaaggtggtgggattacaggtatgagccactgctctctcttggcctgagagagcatttttcattcctgaaatgaacgtgacagcagcttccctgggacactgtttcctttgctagtggtctggttgatgtaatgtgaccacctgattttgatttggcacatgtccccactcttgcctctagggcctcccctggtcatggaggaaagaacatcttcctggatagaggagtgttgttctcttaaaattttgtattatgaaaattatcaacacatggctaatctcatttcatccactcccaagttttttttttattatttgtgttatggaaattttttcaataatgatttttcttctcttccaaagggaagccgttttcaaattcatttcaggaatcaaaaatgctcactcatactccgaccctggcaatcacttcaattaaactcttaaaaatatagaacaggcaaccatcacatacattttgtcttaataagtttcctttatggattcagataatgcttcagttttggatactggccttaatgtaataagaaccagtaaactttcttcctctatgcaagtatacaactataaaaaagaatggtaaaatacatatataatttttgagaatgatttcagttaccttaggagatttcattttatcacaaatcccaagactttacatctttttgcaacatggtatattttgtttttgcaataggcatggagtgaaaaaaagacaaatggggtgtaatgggcattttcatgtgtctagaacaacagtcttcaacataggttgcatattagaatcatctggagagctttttaaaacttctgatgtccaggccatattccatttcaattaattcagaatctctggggtaagacctaggcatcagctttttttttttctttttttgagaccgagtctcgctctgtcaccaggctggagtgcagtggtgcggtttcggctcactgcaacctctgcctgctgggttcaagtgattctcctgcctcagcctcttgagtagctggggctacaggtgtgggccaaccatgcctggctaattttttgtatttttagtagagacggggtttcatcatgttgggcaggatagtcttgatctcctgacctcgtgatctgcccgcctcggcctcccaaaccagcagctttttaaagacaggtgattcctggcctggcatggtggctcacacctgtaatcccagcattttgggaagccaagatacgaggattgcttgagcccaggagttcaagacctgcctgagccataaagtgagaccctgtctctgcaaaaataaaaaaggtgtagggacatgtgcctgtagtcccagctactgggaaggctgaggcaggaagattgtttgagcccaggagattgaggatgcagtgagccatgattgtgcaatgattgtgcaactgcgctccaccctgggcaaatgagaccctgtctcaaaaacaaaacaaaacaaaacaaccaatgagagattcttatgtgcagccaagttctagaatgaatgatcttgctacataaaatgcgatcttagagcttagaaatgcagaatctcaggccatgaagacctacttaattagaatttgtattttaacaaattccaaggtcatcctctttacaatgaattttgagagtcactaattttgatgcaagggtcagcaaaaatgttctgtaaagggccaatgaatatcttaggctttgtgggctataaagtctctgttacaacttcacaactctgccagtataatgtgaaggacatagacaatatgtaaatgaataaacgtgggtgggttccaattaatattaatttataaagagaattagtctgcccaccctttatcctagcatataggcatatttaaaaacaattcattttaggcgatcattaaaaagtcaggaaacaacaagtgctggagaggatgtggagaaataggaacacttttacactgttggtgggactgcaaactagttcaaccattgtggaagtcagtgtggtgattcctcagggatctagaactagaaataccatttgacccagccatcccattactgggtatatacccaaaggattataaatcatgctgctataaagacacatgtacatgtatgtttattgtggcactattcacaatagcaaagacttggaaccaagccaaatgtccaacaatgatagactggattaaggaaatgtggcacatatacaccatggaatactatgcagccataaaaaatgatgagttcgtgtcctttacagggacatggatgaagctggaaaccatcgttctcagcaaactattgcaaggacaaaaaaaccaaacactgcatgttctcactcataggtgggaattgaacagtgagaacacatggacacaggaaggggaatatcacacaccggggcctgttgtggggtggggggagggaggagggatagcattaggagatatacctaatgtaaatgatgagttaatgggtgcagcacaccaacaaggcacatgtatacatatgtaactaacctgcacgttgtgcacatgtaccctaaaacttaaagtataatttaaaaaaaagaaacaattcattttaacaataatacaattaataactttagagaacaaaaagtttccatgagaaataatatgaattaagtggactatctttagttttacctaaaattagaaatacattgagaaatggggcatagtaagagataaataattctacttctttttatatttaactttaactactgaccacaagttcaaaagcagataattttggtgaatgttagcgaatcctgattgttctcactcatacagctaacagaaaaaaaaaaactgttcaggaaatgtgtgtaaatatatatgcatgtatgaaaggtaggtggttttttactaaaactgagtgattaataaatctgttagaaatgaacacaaaatgcctctgtggtaaacaaattttataatgcagaattcttttttttttttttttttgaggcggattctcgctcggtcacccaggctggagtgcagtggcgcgatctcggctcactgcatgctccacctcccgggttcacgccattctcctgcctcagcctcccgagtagctgggactacaggtgcccgccaccacgcctgactaatttttttgtatttttagtagagacgggattttaccatgttagccaggatggtctcaatctcctgacctcgtgatctgcccggcttggtctcccaaagtgctgggattacaggcgtgagccaccgcacctggcctataatgcagaattctttgaagaaacgttaaaggtatcacacctagttttaagactaatttgtgtatgtgtcttgtttgggcagttctcattgcctctggaagagtattttcagctatgtctttaagaatcatggtattttatttcatttttatcttttttgagatggagtctcgctcttgtcacccaggctagagtgcagtggtgtgatctcagctcactgcaacctccacctcccaggtttaagtaattctcctatctcagcctcccaagtagctgggattacaggcacccgccaccacgcccagctaatttttttatttttagtagagatggagtttcaccatgttggccaggctgatcttgaactcctgacctcaggtgatccgcctgccttggcctcccaaagtgctgggattacaggtgtgagccaccatgatcggccaatattatattttaaatatacccaatggtgtgctggtaaatgcttaacaggtggcttgccaaaaaagtatgcattttatataggcacatacattattaaattttactgatataaaggatgtgcagcacacagtttacaaatatacaaccatcttcactgtaaattctatatagccaatttattctcacagaatgttttcactgctgtttgtcaaacttctgtgtccataaccatctatggttgcagttctaccaagatttgacagaatcagactacaaataaatggttgcatactatctgattcagcaaagaagtcacatatcatgaatgagcaagtgcagtgttaccatgaatgttggttgatatttttgcttataagatgaaaatgaaacaataaaaatacatgtcagaacttcactctgtcaatgtcataagtgacttatactatgacaaactttgatttgtagcatttgctgattttttttgttgttgttgttacagatacttctaccatggccgattttaagctacaacatgatgtcactgaacgtggagttgggaagaggtggcagtggcacaccattatgtagtatttccataatctcaagagcataggtgaggggaaatagactaaaacattaggaagtcttcagtgttgagcactgaatgcttgtttttaatgtcagttaattttaagtatatatatatatatatatatatatatatacacacacacacacacatatatacacacacacacacacaaacacaaacatattttgagacaaggtctcattctgttgcccagattggagtgtaatggtgcaatcatgacagcctcgacctcctgggttcagtcaatcctcccacctcagcctcctgagtagctgggactacaggtgcacgtcaccatgcccggctaatttttgtattttttttgtagagacagggtttcaccatgtttgccctggctggtctcgaactccagagctcaagcaatctgcctaccttggcctcccaaagtgctgggattacaggtgtgaaccacagcacacgggccaggataatttaattttttaaattgctatgtttaacaactagattacagaactactcaaaatttaacaactggcttttggctccagcatggcaaatacagaaatattttattcctttatttcccaaagctttccaaactattatcttaaaaatatagtttactctggatagaacaggaaacatttagcacttaccaagaagagaaggcagtggaggcaatgtaggtaacttaataagccccaaaagtttaccaccaatgatggcacaatagaataggattataattccaaataggtttcctccaggaagacattcactgccagtaattgaccaaactacagcccacagaagaacaatgatggtaactgaaataaaccaggaatactagttactatcaataagttgtcacatggaggttttgacaaaatctaaaataatttgtaaaaataaatactgaatgaaaatgcaaatatttataatcatgtttaatctgtaaagagtatcagtaagatgaccaactgggtaactgccaacatcttaagaaatcggatattaccagtacttttgaatctgcctatgtgcccctccccatccatctccctttatactgccagaaggaaccattattttgactttcttcaccattcacttttttctttataattttaacacaaatttagttctgtcttgaattagacattattgttactttttttatagtcaatatttgtttagaattacctactaaggtaccttttttgaaatcatcattcattatggcatctcaaacttttctttctttttgttttgaaacagggtctccctctgtagcccaggctggagtgcagtagcacaatcatggctcactacagcctcaacctcccaggctcaagtgatcatcctgcctcagcctctcatgtagctgggactacaggtgtgtaccaccatgcctggctaatttcttaaaaattttttagtggagacagggtttcatcttgttacccaggctggtcttaaagtcttgagctcaagtgatcctcctgtctcagccttccaaagtgctgggattactggtgtgaacctcctcatccagcctcaaatttttcatctgggacaattatcctgctgcctaaagcatttcctttaggaaaagcatttctataagaatgtgaaataggccaggcatggtggtttatgcctgtcccatcactttaggaggtcaaggcaggaggattgcttgagctcaggagttcgaaaccagcctgagcaacatagtgagaccttgtctctactaaatataaaatataaaaattatctgggtatggtggtgggcatctgtaatcccagctactcgggaagctgaggcaggaggatcccttgagcccagaagtttgaggatgcagtgtgctacgattgcaccactgcactccagcctgtgttacacagcgataccctgccaaaaaaaaagtgaaatgtttccatttgaaaacttgtgttttacaaaactgtgcactaaaaattgaaaagtttatgggaaaaagagagttggggcagaccactcaaaactggtggccaaagcactaagaaaaaccaaaacaatcctaataagagtcttagcacagatgaatctacacactgacatttgtgtcccatacaggcagtctgttctttacagacttaaacctggcctcccatttcctacttcaagatggaaattcttgagggtattttctttaaacagagagcagttccatcaaaatctgatccatattttagccctctgcctcaatacaataaatttcaacaaaaggaaaagcgttggcagcttctttacctcagcttatactctcagccgcttcatccacatgtgttttattagatagcttaatgttgtagaatgtttgagtccttgaagcccctaaaccagctactaattgcatgaaaagtcagcacttccacagagatttcgtcctttaaaaggtcctcatgcagggaaggctttatctttaattgtaagaaagcatatatttggtcttttcttccccagttcactttgccttcacttgctattgcttgacgatacaaaatattatgggccaggaaaaattatacacaaaactgcaaattccatacactctaacaaaattctatttaccattgcatatgagctaattcatgacatagaaacactctgtatcacagcatgttgtatttctcaggagaatctgttacagtaaattcttagttgtatcatctggaattatctttattctcattcttaaaggatagtttttctaggtatacctcagttttatgttaaattctaggttgagtgttattgtttctccattccttgaaaatactattccttggttttctggttttgaagagcctgatttcagctttttaaaggaattctttttccttgttttcaacatcttctctttttctttggttttcctttcagtatgatgtgtttaggtgtgacttccttttgttttgcttaagatttatgttttttaaaaaaaatcagttctggaaaattcttagcctttatttcttcaaagatttcctcttccccattctctttttccatgttgctaaccctagttttcgtatctttcatctttgtgtgtactgcattctagataatctcttcacatttatttgccagttcaccatttttttcacttaatctgctgcctaatttgtccagtgagtttttaatttcaattactatcctatatctttcatttctagaagttcaagttggttcttcttcaaatctattcatttttaaaagttacttgttttgtactcatgttttctaattcttaacttctttatatatataaatgtcttatattctgttttctgataatgtacatttttgaaatctgtttttttgtttccttttgcatgttttttttgtttgttttttttttttttttagtttttttgcaatagtgagctctcccttggaactttgtctagtttgttttttgcaatagtgagctctcccttggaactttgtctaaaactaaactttttagtttgtcttttgcaacagtgagctctcccttggaactttgtctaactttgttgaagccttaggttgaatgagttttcccagatgggaatgaatttacttctaccatgtacttaaaagcttcccatccaagaccatctgaaaatgttttttgaaaatagatacattttcaaattgaattttttctgtgaaattggagacaaatcaggatgaagttaaacatttttattggcgactccacacctgccccagccagcaactacagttgagacaggtttagtcagaggccccatctgcagaacagatttacctcaaatttggcatcacactgggtttcaactttatatgggtgaaggagaatgctttttcctgttagacttctcccaacctgggcaggctctagcttagcctcctgtgctcacagcgctctcaaaatcaatctcaaattccctgaggtggatctagaactagaaataccatttgacccagccatcccattactggtatatacccaaaagattataaaacatgctgctataaagacacatgcacacgtacgtttattgaggcactattcacaatagcaaagacttggaaccaagccaaatgtccaacaatgatagactggattaagaaaatgtggcacatacacaccatggaatactatgcagtcataaaaaatgatgagttcatgtcctttgtagggacgtggatgaagctggaaaccatcattctcagcaaactattgcaaggacaaaaaaccaaacaccgcatattctcactcataggtgggaattgaacaatgagaacacatggacacaggaaggggaatatcacacaccggggcctgttgtggggtgggggtaggagggagggatagcaataggagatatacctaatgttaaatgacgagttaatgggtgctgcacaccaacatggcacatgtatacatatgtatcaaacctggacgtcgtgcacatgtaccctaaaacttaaagtataataataattaaaaaaaaagttccctgaggtttggtagaaacctccagggtggggccaccttgagtgcttactgacctctgctacttacactttggttttggtgtctgatgattccctgttttcttgacagatcatttcaaaagacttaaaacattttttcagatgatgtccttggtttgtgacaagattgttcattgagtctcatctaccatactgctagagactgaattcaatgtccctttttctaaaccctcacagaattgttccagattttctaggcttatgatactactgcagtggaatacctaagggacttccagtattttccaattagctacaagggttgaaatttctatgcgatatcagaggtagaatgggaaagcaggatttgccagctattatactaaattatactttatcatagcataaacccaagctaatattaaattcagcaaggtagaattaagtgttttctcttttcggctgggcgcagtggctcacgcctgtaatcccagcgctttgggagacgccgaggcaggcggatcatgaggtcagaagttcgagaccagcctgaccaacatggtgaaaccccgtctctactaaatacaaaaattagccgggcatggtggcacgtgcctgtaatcccagctattcaggaggctgaggaaggagaattgcttgaacccaggaggtggagcttgcagtgagccgagatcgagccattgcactccagcctgggcaacagagtgagactccatctcaaaaaaaaaaaaagagagatttttctacttcaagactattaaaaaaatctctctttccctgtgctttacttgaaacacagttgtaaatacatagcaaatggtatgtctataaggtttctctaaatcatgtttaaatcagttaacaatttacttctcatttacgattatggaaaaccacaaattttcacatgtaagatttactttttttatttttattttttgagacagtttcactcttgtcacccaggctgcagtgcaatggcacgatctcaacctccgcctcccaggttcaagtgattctcctgtctcagcctcctaagtagctgcaattacaggcacccaccaccatgcatggctaattttttgtatttttagtggagatgaggtttcactatgttagccaggctggtcttgaactcctgacctcgtcatccacctgccttggcctcctaaagtgctgggattacaggtttgagccactgtgcccagcctactttttaagaagaatactgatatatactgcataggcacaggaaaaaatataggacaaaagtcgtcttgtaaacctctggaacagaagaacagaaaaataagcgatgagatgtttatctaccatgaacctcatttttcaggctgctttatgaacgattatacatttttaaaaaatgtgtcccaaaattacattattcatttttactctttccttatgtcagtccatatctgtttcattgtaaacgttttaactataagtaggccatattttgaataataaaagtttaaaaaaataatgaaaagaacagaaaaggtattcaattatctgtgatcttatcagctagtgtatatttttggattctggttttctgtacatgttctaagtttgagattttcttccatgcttagttaagtaaactgacttggtttcattaaaaacacatctagagcctaaagtatagtatattatgcttatctttcattgtcccagatgataatggtaaacatgtctttcagagcccacaaagtataactatggaattgagtctcatttttcagtaaacatatgtgggcatccatatatttacttcaatgatgctattattcttgaacacaatttttgaaattgcctttaaattttctttaaaaggcaaatttagtaagacataaaattatgaaactattagaaaaaaaacataaataaaaagctccatgacactggtctgagcaataactttttggatatgactccaaaaatataggcaacaaaagcaagaacagacaaaccagattacaccaaactaaaaagcttttgcacagtaaacaatccacggagtgaagagacaacctacagaatgggagagagcagttgcaaactatgtacctggcaaggagttaatgtccagaatataaaaggaactcaaaaaactcaatagcaggaaaacaaataatccaatttaaaatgggcaaagacctgaatttttcaaaagaagacatacaaatggccaaacaggtataggaaaaaatgttcaacatttcacctcatgcctgtcaggatggctattatcaaaaagacaaaagataacaaggggttggcaaggatgtagagaaaaggtaactctgtgcactattggtgggaatgtaaattaataccactattatggaaaatggtatggagagtcctcaaaaaagtaaaaatggtactaccatatgatcctgcaatcccattactgggtatgtatccaaaggaaatgaaatcggtatgttgaagagatttctgcactcccatgtttattgcagtactattcacaatagccaagatatggaatcaaccctaagtgtccaacaatgaatgactggatgaagaaaatatgtgtatatacacaatgatatgcttttcagccataaaaaagaatgaaatcctgtcatttgcaacaacatggatgaacctggaggacattatgctaagtgaagtaagccaggcacagagagacaaatactgcatgttctcactcatatgtagaatctaaaacagttgttcatatggaaatagtaaatagaatggtgattaccagggactggggaggggaggagcttggggttatggggagagagtggtcaacaggtacaaagtgataattagataggaagagtagtttgttctgtaccacagcaacgtgactatagtcaggaataaggtattgtatacctcaaaacagaagattttctatgttctcaccatgaagaaacgataaatgcttcatgtgttagatatgctaattagctagatttgatcattatataatatatacatgtattgaaacatcatattgtaccccacaaatatgtacaaatatgtgtcaaaaataaaaataaataaataatgctgatgaatggatgtttatgtttttgaacaattctttttatattttgatgttaaaattatctttatcttttgaaaatatgatttataaaagtgaaaaattgtggatagattccaggcatttaaaagttggccggttaaaactagttttgccagatgcagtggtatacatctgtaacaagctacttgggaagctgaggtgggaggatcccttgagcttaggagttcaagacaaacctgggcaacataacaagatcctgtctccaggaaaaaaaaggttgggtgggggaggtgaaagtggcaggaagaccatgaccaatgccttgacatgtaattttctctagactttaaatctgaagatccatgaaaaaaaaaatgtacacacacgcacacacacacacacacacacacacacatataactcaagtatattgggtgatatatattgggttgttggtcacaggatacaaaatttcagttagacaggaggaataagtttaagaggtctattgaacaacatgaagactgtagttaataaatatattgtattcttgaaaaatactaacagtgaatgtattgtgttctcaccacaaaaaatgacagctatgtgaggtaatacatatgttaattagctaaaattagtcattccagtatgtatacatacttcaaaacatcatgttgcacatggtaaatacatacaattttatctatcaatgtaaaaaataaaataaattttaagtctcaataaaagaatactgtcttcttaaaaaaacctaatttgcctttatagataattttcaaatctcttcttttttctgctttatcacatattcccccagcatacacagcacagacacacatatgcacacaattcatttctgaagaaaaatagggcataaatcaatctgaacttccatatatttatcaaattgatggcagaataacctttggcttccttcaaagaccaaatccattcctgaaagacaaacatatacaagcctaaaaattttcaaaatagtgctgagataaactcccaaagaaaaatcccccaaatgtcttatgtaacagcaactctactaaaataagctgaattgcaaaccaatattcttacttataaagtaataggattcatctggaagtataaatggggctgtgtttgctaaaatattacttgcattacttaacagtaataacaacaaacgtttatgtagtgttttacagtcctaacgtaatcctgtgaaattactcagatatagtaaaggaaaaggtccttgatctgtgttccttcccccttcccacaatggtggtgaccacagtgatcctgaaagccaaggtgaagacagtggagccctgttagtctaggtccttcccttgaatgtgtggagcagagccacccatgtgtgtgaattgttcaccaactagtttttatgtttgggagaagtgaacttctttttgtcctttcaaccatattatttagtaatctgccattataacaacttcatcttttgccatctctttctgaattcatccttaccatttgttatgaccctgtccagtaaaccatgtggagggcaagccagcatttgtctcagtctttgtacgtgatttgcttcagttggtgtttcttgtagctttttttcactgcttttcaaaagaatacttccttctgttggttcatttgcatctatacctttgagcttcataactgtctcctcctgtgtttaaagtaattttaaaaatccttaaaactgtatatattttacacatatttataggtactgcatcatcaccttacaaatcaaatttctatgactagcatcaaggataacactttgtagaaaaaactcacagctttattactagctaatcagcttgaaacaagaatgatactaggagtatttagcacagtcactatttttagtacaggttgagtatcactaatctggaaatctaaaatctgaaatgctccaaaatctgaaactttttgagcactgacatgacacacaagtgaaaaattccacacctaaagtcacatgacaggtaacagtcaaatgcaactttgtttcatgtacaaattatttaaaatattatataaaattaccttcggattacctgtataaatatgaaacataaataaatttcctgtttagacttgggttccatctgcaagatatctcattaggtgcatgcaaatattaaaaaaaaaaaaaatccaagacacttatagtcccaagcatttcagataagggatattcaacctgtattataaatgcttgggtcacataacattttattatgttttataatactgggttttaaaataagcatatttaagataaaattcagggcaataattggcacatataccaaagtggtttagaaaaagataactatctgtaatgaaaaccacttcacattcattaatctacttgaatttaaacaataaaaaggaagaaaccaaaaccattctagagattaggtcagagacacaaagcgtttcataggctctccatttttctagttacaggtagggtcagctggcaatgatgttagctgggaaaactggtagtcacacctgccttggattgtgtaagtttggggataggagaattggtaaatgagtggtagaatatgaagaaaacacaattctatcacagcttagatttacctgtgcttcttgatgcatggagggcgtgtaattcattcctgtggatggttctgaatcttcatatgtaattcttttatcttcatcccccattatttataattaagaagatgacacagggaagaggaacgagatctgttttgaaagagtatagatatagagcagtaatttgaaagtcttgtgatttcaaagactttggattgtacttatttttttccctaaaaattccgaatggctaaactatttgaaattagactattcttaattttcaatggctggttattgtttttgcttgattctagtatattatcatcattcttatctacctttttatttttcttgaaaaagcctttgttgaccaatcacatttttatgatttctttcccatattattttttgagttaaacttaaaaacaatccaagcaatatcagtgttaaactgtcctctctcatgggccaactggatgaagcaggaagtctccaggtaactttccaatgttgatatgaggaatgagtcactaaagggaaatctctggatttcatccttttcggagaatctagagtcactaactcctgcctggttcttatttctaaattaaagtttaaaaatacaccacaattgactgagtagccagaatgtctcagacactatgatgagtgctatggtagtcactttttagtcattgtgggcaattcaaagattaccaaaacatattgtttgttttccattgacttatcatataccaggaaaaataaatttataccaaataactaagaaaacctgtaagactacggattggctcaataaacactcacttcaacacattctcccttggctttccatgctatacaggctacaaggcaaatacagcactccagttcctagccacttttgtaggtagaggtggccatgtgtcacagttctacatatgagatttaggtgggagttttgggggaggcctttagaagataatactttgtactttttgtcctctaacatttccctttctccttcctagaatgtagatacagtgcctggaagggcaacagacatctttcaagcatgagaataaaagccctctatttaggatagtagataagtaagataggagaagctggttccttgatgacatcttccagttgctccatcagccttggactgccaagcattggggtaattgtttaaaccactattaatcaagttttttcttcttttttaactagtaaggaaacttactcctaatgcaacaagtagaatgagtatcttgatagaggtacacactacaaacttgtggtagaatcaaagagaaaattatgtaagagaagggaaaatctaattcaacacatatcaaagtgcctaatgggttccaggcactatgctagacataaagacaaggatgaattagacaggacccctccctcaaggaatcattttctctgttcaacgaagtgccaagaaatttgcatttaaaacttcaaaaaacatcataatctttttaccacaaccacccccatttttcctacttacaaaacacatggtaaccagagtcccatctcaaaaaaacctttagtttgttttttattatacataatttgtaataaatgtttatataatgatatatatgtatgtgtatgtatgtttgtatatataattttttaaattaaaaaacttatttcaaaatttagactgataataaaaaagtcacttgatgagaaaatgttagactcagagaacacttgtcttaaaggcatggagacatgaaagccagtggtgtgtgaggggaaactgctggagcttgtggcaggaggctgagagtaatgcgagatcaggttaaagagttaggatatcatatctcaaaccacggcacttggcctttaccttctgaagtgaatgaccccaaatatggtaactgacaagatgggctgggttcgaatttggataagcctgaatttgaagtccatctataccaaattgcttaacctctttgtgattagtttcttatttatgaaatggagacaagaatagttctaactatgcacagttggcattcaatagtgttggttattgctaaccatgcatattccttcttcctgattatcataagaagaatctttaagaatcattttgctttccctattaagcaagaaaaagtcacctcaaccttgaagaatttactacttaatcccattgattttatttggtcatgatttttcatctgtttttgaggcccacttcttgatcaggtggatgtaacattcatttcttcacccttctcattaggagaattacatagaaattctttggcagtaccactagaattacctctttcatcaaattctcaaaatcagcccattctgccacttacaaaaactatttttaaatagtcgtgaattagaaattattatttttagtagacaaaaactattggttaaaatgaagcctttgcgaacaaattttatcaatgttattatggggtccttttaaatataaacaatcacaacttggcatgttatgccatctgtgggaatttatataattttacattccagaaaagttccctattctccaatactctcaaccataaatgccaaagtacttatacatgatcagaaaggtactgcagaaataaagggtaaaatgaaatacatgtcttttaatgagcccagtaagagatcttacaactagtcagctgtatttgtttgctctctgctgtgtttccatttctaaaagaccatttaaaatgcatgtctcacttcaggaacctacttaaatttaggaaaatttcaaaaatgttagctttacttaaagtgaccatgttcatggtatttattatttatagtcattgggtcttgaaattacaaaaatgacctttgaagggccataaaaaatgtcatgaaatgcttattagaaagtttattctccttactcatagagaggctcttaaggactcatgcagagcccattaacccttattttgttttgtttgtttgtttgatttttgagacgaagtctccctctgttgcccaggctatagtgcagtggcatgatcctagctcactgcaacctccgccgcctgggttcaagagactctcctgcctcggccttctgagtagctgggattacaggtgcccgccacctcgcctggctaattttttgtatttttagtagagatgggttttcgccatgtcagcgaggctggtctccaactcctgacctcagtgatccacccgcctaggcctcccaaaatgctgggattacaggcatgagccaccatgcccggcccttatttcgaaaacaattctaatgactttgctcctttgtttttcaaaccctcagaagattaggtgttaaatattaaaattcaggaagagattgctgtgatagaggcaaattgagagcagcattagtgactgatgacagtgaaagagatgaaaaagacagcaatctaagagtcatttatagtgggggcgacagagcaagactgtataaaaaaagaaaaaagaaaaaagttttcttaaccttttctccccacttgaaagaattgtccttaagagatcaagaatataagcagtttgatatatgtacctgttaagaaggaaacagaaaaaaaaaatcctttaacagcagttgcctttgggaagggaaatggaagaggagtggctggactttctttcttattttctaagaaagattttcttatgtaggattttcttatgtaatttgatatatatatatattttgttgttgttgttgttgtttttttgagatggattctcgctctgtcacccaggctggagtgcagtggcatgatcttggctcactgcaacctccgcctcctcggttcaagtgattctcctaccttggcctcccaagtagctaggactagaggcatgcaccaccacgcctggctaatttttgtattttttttttttttttttttagaaggagtctcactctgtcaccaggctgaagagggattgcaatggcacgatctcagctcactgcaacctccacctcccaggttcaagtgattctcctgcctcagcctcctgagggactacaggcacatgccaccatcccttgctaatttttgtatttttagtagagacggggtttcaccatgttggccaggatggtctcgatctcttgacctcatgatccacctgcctcagcctcccaaagtgctgggattacaggtgtgagctaccacacccggctaatttttgtatttttaatagggatgggtttcactatgttggccagaatggtctcaaactcctgacctcaagtgatccactggccttggcctcctaaagtgctgggattagagatgtgagccaccctgcctggccctaattttaaatacatttaaaaataatctactcaattcctaaagctttagagaaaagaaaatggtaccacatttcttggtaatatttctcatagatacagtctggtgatttgatttgaggtaacttaataacacctgccacaatttaaaatcattttttgtagttgtgatttttcaaagaagatgagtaactgcccagaatcaccaatagcagtggttttcaaaattttcaagtttggctttcatgttttttttttttttttttttgaggtggagtttcgctcttttgcccaggctggagtgcagtggcgagatctcagctcactgcaacctctgccttccggtttcaagctattctcctgcctcagcctcccgagtagctgggattaaaggtgccggccaccatgcccagctactttttctatttttagtagagatggggtttcaccatgttggccaggctggtctcaaactcctgacctcatgatctgcccgccttggcctcccaaagtgctgggattacaggcgtgagccaccgcacccagccctggtcttcatatctttatgtcaaatatctttcatcaaatgaaacctaatccttaaatcctacaaatggaacgactaaggtggcgctgcaggagccctgtctactcacccctgttccttctggcaagtggagcatactttggaaaccatttctgtaaatatgttttcacatagagagatatttgttaaatgttctctttttcatattatcttactaatgtaaatgtttacaagtactttctgtaatattccagaagaaataaaggaactatcaacttacaaatgtccgtaggctctcggtcaagtaaaatagacttactgctatcatttcagttactgctaaaagatatggataaagactttttattcttgctatttgctgcctgtgatttggataggctgacatttaaaggagtaatcttatggagaatttacatatattgcttgctatggcttgaatgtttgtgtccctccaaaattcagattttggaatgtaactgccaaggtgatggtattaagagggaggtactttggggaagtgattaagtcaccagcactcaaccctcatgaatgggactagtgctcttataaaagaggtcaaagggagcagcctagtccctttggctctttcccttccaccatctgagaacacagcattagtctcttcctccatgtgaagaagacatggcaagaaggcaccatcttgcaagcagagatcaagtgtgtaacagacatcaaatctaattagcaccttgacctaggacttcccagcctccagaactgtgagaaataaatttgattatttataaattaattagtttgtggtattttgttacagtaacaaaaatggactaagacattgctagagtactctgggttgtattcatgcctttgaaagagcatcactatgattgttcaatactctataatgataataataacaacaatctcctgcctttgtgttcatccattcatgtgttgaacgtataggttctcagtctcatacagtatttctacatagaacatacagaaacattccagtttctgtatttgcttatcaacactgatctaatggtcatttcccaaaaggagccctacccagcaatgaggaattcagatcaggctcagagtagggcttaacactttcttagacaattaattactaaaatgactaacagtgtttccctgaatgagaactaccttatctgaaagacttaggtgtgtcaaatacatgtggccaagttaccaaaggaaaacaaccgctattttatttggttaattgatttagtaatttcattgactcatgaaggaaaacactatataatgagataagaataaaaggaaattacccctacataagggacccaatacttgctttcatcctttctattctctctcctcaccaaagtgaaatatacttactaaaagtttaaaatattatttctaggcccactaaaatcagaatctacagagaccgaatctaccccaagtgggacagacatgacttatggcctgtctaaatgccaagtgttcaggtatgccagtaggacccttctcccgccctagggataagtcattattggtgtaaatcaatctctgtaacaccattcctctttgccacttattggctaaggagtgagcatgattcatttcttgccattggaatttgtaggcaagactattggggcatattacataagattttccttcttaataaagacagagagagaggaggaaaatcctctcctctttttgtctttaaatgaccaggtaaagaggcaagggaagttgggattgtggatgggtttcttgggacaattctagcagccatcattcacccatgaagaaaagtcaagattagctgaacacagaaagcaacatagagccctgatattactgagctactgaacaaaccctggacccacctaccttcaaacatcttcatgtatgagcaaagtacatctgtatttttgaagggagttttggctgaatatcctgttacttgcagccaaaagcatcctaaccaatataacaggtgattttgttgcagaaccatccctgagaagccctgatgaacagcagtgatgaggaacctctgtcttacaaactttagtttctatctttctagcttcttgttacagtgcaaaatcatcatagacaatgaatgatcagaacactgcctttgtattgaaatttctcaaaaatgtccagaaaataacattttataaagttaaaaattagtgccaaggttttcactgccattcttttagtcaacagaaattatttggattgtaagattatgtatttcccctcctctaccctgaagttaaattgtaatatttgaatactgaatgaagaaaagttggacttataaacgtttggttgttttccaaatttccactcatgaaacaaaacaacaacaataaaatatcactactattgctgcctggagtttcatttctgctttttctacttgaagaaattcaaaatctaactcaaatgtcaccttctcagtatttcctaactccaacattgacaaactgtctccctcgttttcctctctgatgattcattcattcattcaacaaacaagagctattaagctcttgttacgtcccagtccttgagctgaggattcagaagtgaacggtcttaaatagttcctatattcagatcttgtaatctagttacaggatgataaaggatgataaatgattcctaagcaatcacaatgaaatatggttaagtttcaactttagacacataacaaccccatcccttaacaagtttcatttccttttttttcttttctgagatggagtcttgctctgtcacctaggctggagtgcagtggcacaatcttggctcactgcaacctgtgcctcctgggttcaagcgattcttcagcctcagcctccggaatagctggaattacgggcgtgcaccaccatgcccagctaatttttatatttttagtagagatggggttttaccatgttggctaggctggtctcgaactcctgacctcaggtgatatgcccacctcggcctcacaaagccttaacaagtttctctggtgtgataggcacaagagtaacaaagatgactaagatgcagtctgccctttaagggatggtcagagactgatatgtgtttaccaaaatcgtttactcttctgcctgggtccatagtacatttccagtctcccttgcaggtcagtgtggcatgtgactgaagtctggtcaatggcatgtggacataaatagtatgtgatttccagtcctcacccataagaaacaatcctcatgcaatcctctagtagcttttctttttctgtccgttgcctggaaactaaggactccaaggtcttaggggatagcaaagccataatataaaaggagtttgggttcctgaataattgagtagaaggccaacagctgaacacgtgaatggacttgacatgaacgagaaataagcctgaactatgtttagttactgagatgttttactttatctcttacagcagctactgctgtcttaaggttatattcttcagtcaatagcatacgatgattcttagcacctcgaggatgctaacccagtccacaaaggcaacaccccctctggttaatctgagaactaaaataaaagcaagcaagaaaacccacgccaacaccttacaacagtaaacagacacgcgcccgtcaccgggtgtacaaacagaaaaggctgggcccctcgctcgcgtctccggtccagcaggcctacagggtacccgccgctggcgctgggtttatttttacccttagtgtctctggggcctctcacctggcagtctccggcgaagtcgaccaggctccgtctgaacgattaggaaaggggctgtgggggaggcggcggagcccggtctagccaccgcgctctggggttcccgattcgcgcatcttcccaggctgagccgggaggctgcgttgactgcagataaacggtctcagggcgcggcaccgcgtgtagtcggccccgcctttcgcacgaacccgctgggcgacaccgcgcagggaggtccgacccgtcggcgccggtacaggctccggagtaagcatgggttggtccggggcccgcagcggcagccccgtgtgccctccgccgggtttcaggtccggcggcgcgggtgcagagccgcgtgcgatgcctggtgcgcgtggcttcccccggaaaggtggcgccaggccgaccatgggcccacgtcccggggcctcggagcggcaccgcgcggtctttcagctgcttatcctccctgggcgggtccgcaggcttctggggccaggaccagcgagctcccgggaaagcttcccggaaagcttacccagagagcgcggacccaggcgccgagtcttcccggagatgacgagacaccgcgagaggagcacagcgcaggctcctcgggactccgcggcgcaggccgggcagcccgttacttgttttatcgttcccgaaaccaacctctaagttgtctatcagtcctccaccttttagctgtacctcttagaagtgtcttctcagctgcggtgggaagataggattctttcttaaggtgaccaattaaatggccggataaaagacttgttctgcccccctttatcgcttaacacctgcccttcttgttgtattttagatttttaacccttctatcagcagtgtgattctatttcatttaattctcatttcatgtttgtgtcttccttttctctgtatttcctcttgtgtgtgttaagacgcgcgcaccccttacctgtttttcactcctgtaagcaagtgccaatcttaatcaccgcttttcaagcaagggagattatcctcaaatttctccaccagtcagaaaccattcattcttgtctctcaggtcctcttttgtgatgaacctattggataggttccatccaatacccttcttcagatcatctgaaatgattattttcctaaacggaactcttcctctcctaaagcttgtaaaaatttctagtgacattcagcttcctcttaccacaggaatgacatatatttttccttttagtcatatgtacttcattaatatatcacctgatttgattaacatgactttggagaacattgaattttttggctagattttacttcgtttttattgctgatagtgtttataaaaatgttttatagtttatggtcggctgtgagaaagactaactcagatcatttgttaatgttggagcccattttgtagaattcgttgtgcatttatttaaaatttatttgttcatagctatacatatattatacatgtatacctgctcacagcataaagtatttcatgacatacttgtaagagtcagtgttctatgaattcactagagaagttacagcattttgattatgatacacgaaaagaaacccaagtcatttagcttaactccttaatttcataaaccagaaaactaaaatccaagatagattgggtgacttggtctagatcacaaaccaaagttagccataattcggtagtgtagtgcccggtccaaaacctcatagataatcttataatcaatggactctttctgaatgctagtcaaaatgtccttttgtgtgaattttaatgtaccgtcatcaactgcatgatattcttccccatacacaaagtgttatctttttgttgtccatttcagaattttccatgttaatattaaagttctaggaaaaaaggctaagaatcactgcacatttattgagtatctcagtgtgcatcataccatttggtcatttgaggttgcaacaagtaaaaaacaaacataaaacccttaaattaaaataaaaacaaaaaactttgccctgacaatgttacagaattaacatccataaatttacttttcttgaaaaatttattttctttaatttcgtttgtttcctgttacataatttatatttaaatttacatttatttatccagaaactatgtccaaattttatgtcctcttttctgttatcctggagtttggtgaagaaatctgtacttaatttagaaaagaaatccctctaactgacaatattgttagctaactatatatttcttaggcccatgtcaaatatcattgcttattttaataaagattgtttagttagactaagaaaatagtaaataataagggatggcatccgttaagtataaacactggattatttttcataacataacaggtcaacaatatcgttttgaggctgaactcctttactccttttactgtaagctattgaagccaaactccttcctacctttgttcatttatgatggtgtaaaattttaaaattaggatctacatacagaacaatgcagaattatataaaaatatttgaatattgaaaaatgaagtggaaattattattattatttaggtacagggtcttgctctgtcaccctggagtgcagtggcatgattacagctcactgcagcctcaaactcttgggctcaagtaatcctcctgccttagcctctgttaaccatgctggtcctgaactcctggccgcaagtgatcctcctgccttggcctcccaaagtgcaggaattataggcatgagctaccatgcctagtcctgaaattactatcttcttccttaacccccatctcccccacaaaaaaacaaaaacttccttttttcttcatatttacattttaattgtatatgctgcaatggcctatttgtatcaccccagagtcatgtgttgacatcctaacctgcaatatgatacattaggaggtggggcctttgggaggtaatcaggtcataagggtagtgccctcatgaacaggattagtgtccttataaaaagacacatgagcgctcgctttttttctctgctcttgctatgtgaggatacagcaagaagaggaccatctgcaaaccaggaagtgggccctaaccagaaactatatctgctggcacctttatcttgcacttcctagcctccagactgaaaaataaatgtttgttgtctatgacactccatctatggtaatttgttatagcagcccaaagtgactaagacagatgctaacaaatcgagatttattttaaaaactattctcctgctatgagttcaatatttttatttctttacaatgatttcagaagagattacaaagagattaatatacttaaagaatcagactcttgcaaacagtgacatcattaaaaagagcttattttcattaacatgtgattaacaggaaggagatgattggtgagttttcttcgtaaccaggttcactgtggataggaagggcctgccttccttcccaccatggagatcctaaaatcacaagctccagcctccatcaatgatgacagggttaccagttacataagcagactgcagtgataaacacaaggagacagaacaattaaccaggtttgatacaggctgtattttgaaattttcctgtgactaggataactaaacaatttacccttgtcctaacaggaaacctcacttaaacacttaattcagggaaatccaaattaacatttggttgatttagaactgctgagtgtcctgtgatctggaactaaatggcctctggctggtgtctaagcacctgtcactgttaggtatttggtctcagaatccccaaattaaggaacagtgatgtatagccattccccaaattaggatataggctaaaagcacattttcattttgaaactcagaactattcaaaactagctaagttttatgccactaataaacttttgaacataagtgtatcagtcataaaatggtcatattaatgaccagttttttaaaaaagacagcatatatttagttgatcaattataagtggataattgtaggagctgaagcacactaaatgtgttttaaaaatttacatgaatgataataactataatccattaagctataaaaatattctatattagtttcagatatccaaatctttataaaactaaggaatttaaaaaataattactggtttattcccataaatttttcattttctaaataaggctgaagtgatctttttggtagaagtttaaaaatcttttaacttaaaatggataataaagactcaaacagtctaaattcatctgaagcctgaaacaatggaagaggaagtaaggatatcataatgaatagagaaattttaagagttcaatagataaaagctgataatatacagtaggtgaactagggagttattagtcacttcaccaaagaaatacctccaactcccccaagttcttttaaaagacaagctctgttacacatatgaactcctctggaaacctctaaaaagccaaaggtacttttgtagcacatttcaagccacaacacttccaaatatcttgtaacctaagctctggctaactaagggtaatttagcttatcagcagtacccaaatcaaatgagctattctgaagatacggattcagagaaatcacaaaggctcatgtgcttcttcattaaacatttgtctattaatttccccagctattaacaattgttgttaatagttgggagaagttctgagaagaaactgcgctgtcacggaaacatttcaatccctgtatttgtcacattcaccaactatctggtgtgcaccaagttactgggaagaggagctatcagttgttccctcctcgctcccgcctagtcccctttccttccctcttctcacacattacagttccttgttcctgtagtattcagagacataaaacagaggaggaccttcttgtgctctataccttataagcatcatttttgctttcatcttaagccatttaaaagtaaacaatagttattaaggaaaaaactgttaaacagatgcaaagtggaagagattaaattaggaatttccatacacgatgatgaacaagtaagaatttttaaaaatatttatttattttgagacggagtctcactctgtcacccaggctggagtgcagtggcgcaatcccggctcactgcaacctccgcctccctggttcaagcgattctcctgcctcagcctcccgagtagctgggactacaggcgcccgccaccacgctcagctattttctgtttttagtagagacgaggtttcaccatgttggtcaggctggtctcaaactcctgaactcaggtgatccgcctgcctcgacctcccaaagtgctgggattacaggcatgagccaccatgcccggccacaagtaagaattaatagagaaaaaagagccagtggaattctcccaaacaagtcacaagtaaaactaaaacaccacatgcgaattctgtgtccactgaacacaaatctgcttaatcctctccccatttcacttagagctcttataatcctggaggttcaattttttgacttgcatttaatcagggtttccccaattataatttttgaaaggaactgtctctcagaaaattgagcactttaacttttttagtcctccattttgtttgctacaagattttatgtaaagctgaataaggaagaattagtggctcagatcgaagtggtctttctttgagcaaattaaatgagaacttatccctatcttataaatgtagcatcttagcacatatatgccacaaactctctaaaatgatattattttgatgagcaaattgtggccaaatgtgattgagggtaatgaactccttgggaagaatagtgcttacttcatcagaagccaaatacacgcagagcatggctatttcttctgcagttgcgaatcttcccgtcttttgtctcttcaggaaatcattccgtgcctgtgaccagagaccataccagacattagtgatggaagcagctgtatgtgctcacctgcatcttgttcaaggagttaaaggcaagagaatccactggcttgctgccttgatgaataatcaactagggttatggtgattcttttgccaaagttactcaaattgtttgtgttatactaaaacccacagatattgtgacacatcagaaagctaatgttaaaggatgagggcattattttttcatcttcaaaagttgtggtaaagtatacagaatataaaatttactatcttaaccattttaagtgtacagttcaatagtgttaggtacattcacactgttgtgccaccatcaccactgtccatctccagaactcttatttttattattattattttttcttagagacagagtcttgctctgttgcccaggctggagtgcagtgttgtgatcatagctcactgttgtacctcaaactcctgggctcaagcgatcccccagcctcagcttcccaagcagaactcttttcatcttacaaaatggaacctctctactcattaagcattaactactcttttccctccttccaagcccctggcaactaccatttcactttctgtctctatgaatttgtctgctataggtatggaagagggcatttattaacaaaaggtttaaatacattttaaatgctagatgtacctcttcaggatttcctctggcttgtattctttcttgtagagatggcgtatcaactgttcctaaatcaaagggggatattcagcttggttactcactttcactgaaaaagaaatcgataactaaacttcctttccatatgacaatcagtgagattcttctccttgacttaaaatgacaactttacagctgcctgcctgaggcctcttatttaataggcttataatttcttcaataacatttctatgattttaaaaacacagactatgattcttcgtgacactatgtagggactctggatgaatcacccagcattctcaaggacatatattttagtcacattgcatttatatgatgctttatggattttaaatacatttatgcatatgatctcagctaatcctcacaataaccctgagatgtagataaaatcgtacaagcactttgccagcttaaggagccagtttgcctcaatgatctcaaaaccattctttgctgtcaagttcactgtggcatctttggggacaatcccatggctaccatagtccttggtaattcaggtggcgctaaatttttcttatcaccttgcctattttcattgtttcaaatgcctacttttaaccacagtttcaagtttttaatcaaaaatataatttaatctaatttaaagttattttactttaaaaaagaaaaataagaacaacgctaacattttaaaattccacttagtttatggtctcctagagcacgttacccagacttttttgttaacggacataaactgttcattctctttagagggccctttttcagactaaagagtactctggcaaataatgtgatctttctgaggttgtaacaaatggttttacagtcatacttcacccttagatcatgttcctgagagtgccatagatttgatctttattcagaaaacatttcttaattttagcatcatttgctatttttttctgatgaagctggaaatcttcaaaatcagaaagcctgactccattttggaaccccctctttaggttggttatctgtctcttgtcacattttactataagcagccagcactttcaagactctgggtagaaatcaccttaattagatcacccagttcattaggaacatcttctaccttcacactacaggcaacagtgttgatgtactttctgaaactgtatgacaaagacactcttttttctaattttcaataatattttcctcactttcctcaatagcctccttaaagtccacagttttaccaacagtgtgcacctcaagctttcactaacactccttcagaatcttacagctttaatagctttctccctctgaggtaaatgaacatcatatcttacatatgactggtactaatggctattaaataagaactgtagagcaagcccatgcctttagagtattccaatgtcactgggttcagctgtgtccatggcacagacatactatgccagggtctacacaagtctggctggagatttgtgactatacaaccatcagcagcatctcagacatactcagtcctcctcaagttttcttctgtgattggttcactgagtcacagctagttccttgttccaaagagtttgataacatattttccaatctcctgataagtccagtcgctgaaacaaccacattttccaaatcattttaccacttattccactgggtaaatggcaccaagaatagctagactcaagtatcgccaggatgtacattaaaacccaatgaaatgacctctcatgcattcttctttttcttagcgttacctacgtttacatttctgttccaagaaaaataaaacagaacatctcaatcgctgaaattctgtagcttgggggatgtttagtttcccctctttaagtcagtgggtttcaactgaagattcaatcagaatctcttgtgggtctttctaaaccacacaattctctccatgaactccttccctaaattctggcatgcccttcaggtttgaaaggtccccaggtcatattgaaatgtttccctttcacacaccaccccccattatcaattgtgcactaccaagggaaaccttgatcctggatatgcaatcatttctttttaaagaatattataatccttattagataccttaagttccttttagattggtagaaccaggtaaaagtacatatcaatttaataaacacatctacggttattgtgaaaatgagacacacccctatagttattaagaaaaggaaagttctgcttttcttctttgctttgtatgagggatcggcacacctttcttggtaaagaggcagacaaaaaatatttatggctttgagagtcattttatctgttgcaactattatactaaactctgcctttgtagcatgaaaacagccataggcaataacataagcaaattgggtgtggaagtgtttcagtaaaactttgcttacaaaacaggtgtgccttactcacctgggcacacacagttgcacctgatgccctgctggatgaaatctgcagccacagattttgtgaggccaatcacggctgccttggttgtgctgtacacacatctgttcacaactcctgagggtggaggaaaggttcaacaattgaaggaataaaaaatgtattttccttcagaaaggtaacacaaataagttttcccagtagccattttcatgctttctcccacattcctccccttttaaaaagattgatatcagatttttttccttcaatagagtcagtttctggatctagggaaataatatcagtataggcacaacttaattgagacttaattgaaatgctgaacttacttaacattggtagtcttagtttctcatcatcagttgccataactcttaggcagattccaaaagaaaatgaagattaataacaaaacaaaacaataaaacaggaggcctaggcacttctttacattcctctcttgtgtatgttgaatatgtgtatccttgcaaagagaagaaatggtatctcagcagtaactatttcattttaaactcacagatccaactatgccagattgtgacataatccacattttgtactgctgtccttgtccttcaacttgacttcttgctgatggctcagatcaactgtctttgtgaagcattccacaaactcacaggcagttatttccctgtattttgacagcgctttgtacaaacctctgttatatatcatcacactggagaagatgatgtttgctgccttgctcctagttttggactgtgaattcttttatggccagagcacataccggtgctcaatacactattttaaattaattaaatgttaaatggttctttctcccagtttgatgttcatttccatgtccattagaaagaataaaagggagggcaaaaataccccacattttaatttaattttaccactggctcacatcgagagcaaaagatctgtggttaaggaacttaataccaattttgaaaaaagcagttttgaaatcatttcaatacttgaaattataatctctgctatgcctgttcccaaacgcagagctcttaatgatgtgcgtgtatgagcatcgcagtcctcggaaggagacagacccacctttgacgctggaagccacagaagacatgttgataatattgccagatttctgagcaagcatctgccaaaacaaaacaaatacaaaaaaaaaaaaatccactttgtgggctaaaatactaccttttaaaaagatttgcattttcttagggtttgcagaatgaatttaattactgtattagctagtcacattaagcactattaagcagtcttaacagtgaacccaaaacacctcatcaactattgctgggaaatgatggcaatgtgactgcactcactggcatttcccagggggattaccaccttcccatggtacaagaatgtcagcaagactacgagtgaatgctgacttaaatgaaatgtgaataaatgttgttattgtgtgttactgatgttgggaaacttactccattcaacacataatttttgaatacctactgaggccaggtattgtgctaggtccaggagattactgcctacaggaggcaaccagtctggttagagtggctcacataatccacatccagccacagcagagacctccacagagatctaacagcagggtgagggcagaaagggagcaattcaggctgggcgacactcagaggggacctcctgagaaggaaggatatgggctgaattttgaacactagagtattagtcagaaaaataaaagaaaaggatgttttgaggagtgggtacacaggtataaaggttccatcgggaactgggaggaggggctgggtctggctggaatgcagggtgtggaagcaatgaggctgcagaggtcaacaagggctgaatttagaacctgggttttaccctgaaggtgatgcagtgacactgaagggtttaaagcagagaagtggcatgttcagacttggggattgcaaggattactgtggtgcccagagactagtggaagctgatgcaggcttcaggaaagagtgataaaggtggagctgcagaaatgtctatgggtagctgaggaggagagggctgaggcaggatgggcaggaccttgtagatggttgctgcagggatggtgggcctcaccaatttagggcagtgtttcctaagaacaccttcttcagaattcccccactaaagtgtgaatttattaagatgagggtctttggctgttttgtcctcctagacagtgtacacagtaggcagtcaataaatgttgatgaatcagaatctcctgaggtgctagtttaaaacacagattgctgggccctgtcctatagctaaataaatatataataaagaaaactgctatgaatttaaaaatgttttcaaactttactaattataacatgtacatagaagtctcaataggcagtgtaaagggccagagaaaaaaaatgacttctgttgggacgagtttctttagcagcttttagaaaaagaggtgtaggaaaggaaaaagtaaataattgaatggatccaggattggtgtggccaagatgattgatttcttaggatattcttctgactttgttctgagatttagctactaattgcccctaaaaacagaatctaaactaaccccaaggcactatgctgaatggagtaagtggatacaaggagaggctgactgtaacccaaccaagctaaggaagacagcaggggaaaaaataatgtttaacttaattgtgtgttttatataataaagaggatcataatgaaatggggttctcataaaaagtgtcaagaatgttggtcaagtgtaatggtgttgaaaagtaagccttaaaattgttctttcttatccaatttagcaaatagcattccccatttaaaatacatatagaatacatataccccaatttaatacataaagatgggttattatgtaggttcaatctctagtcctctctagaaatgcaatattatctcaggcaaaaccttagaataaagccacctaagagacattacattagtgctgccccctaacacttgcactatccattcaaccaagttcaaccgaggtccctctgctgcttctagagcccctagtcagtacctgttcccatgctgccttcccagtccaggtcaggagctgtcgtcatggtgtcaggctctccctggctccccatgcaatagccttctctggcaggcatgactataaagtcaagtgcctggtacatagtactgctatctaggattgacctcccagaagcttaggtaggggctagaaataccccttaagagtccctggagctgtatctagttagtcttactctgacccagcccttctgtctccattggccagagctcagcccctaaccctggtggaacctggccacttgggtctccagtggttcctgctggactaacaaccttgattcatttatttatttgacaaatgtttgtggagcacctctatacgctgaagactcttctaagacacagcaaggtgggggaaaaaagcaagcaaacaaaccaacccaaataacaaagatatccccaaatctttgccctaatggatcttctcttctggtggagcctggattctgcattgacctcttcttaaagtattttcaacttgttctctgccttttgactgatcttccagtcttggaatgctttcctgtgtatctatccatgaataaaaatttcctatgagtgttcctatgttctgaccagctgaccttccagagctgcctagactccaaatcctagcttcccctggaaagttctaacatgggatatgtgtgtcatagttaatgatacagaggatcatagataattatggctggaagtgattgtgtaacctatcatcctcattttttagctaaaagaaatatgtactgagagggtacaagtgccatctctatggcacatggccaattaggggcagggcgcagactgcacctaaggacttctgatgatagagtccaagaccaggattcgattttgtcaaggtcactttaaacaagaggcactaataccatattcctgccattaacatctcttgggatttttttttaaacaaatctgtgtttttggcccacatggataattgttaagatattgtaaatcacaagcaaactcactagtttgcaagttaatgtttgtatattttaaaaattaacacaagtttacatttcagctccactgtactccacacctacttcctttactaaaatttgtaaagcattttagagcctggttttgcaaatgagtctcatgcatgtgcaacagtcttacccacgatgacctaagctttcctcctataccacagtctctgctctacccctgtaacctatgcaaaggatctgtcttcaaaaatacattcgtgttccaaatactatagtttctcataaactccaaataggctaaaaaatcaacttacattaaaaaaaacaatttgttataaaaatttgctagttcaacattctgtggacccacccaaaaatcccttctaagcactaaacaagtagatttttcaaagtcccttcattactaagtcagtttctctaattttcctgttaatgttcatctggaaccttcttaacattaggttgaatattcagagtagaatatcagccctgctgtgccattaacaaagctcttctcctgcccagacatggacaggacatcaaatccagctgggatggaagggaaaagttgttcttctgcatttcactaggttcaatttacaaccttgagttgagctggctctgtacccagtcaacccctttcattgtctcagcctgcactgtctgctactactggtttataagctcatttgaaatcagggatgtacgctgctcatgtttatactcccctagaacactttatatagtgatttataccaagaggtacttaatgctagtttataaaataaaattttaaacattgatgcgttgtgtgaaggcttgagaattcaaggaggaatgctgtcttgagcacacactgtctctcacctgcccagtaccactgtggttcagatcaaaacaagagcgaagggagaagcttcagggcagagaaaagcaatggggtacatccctcttgagagtgtgagcctagactgaaattcacgaaggggctcaacgtccaggcttcaaatcttggttctaaccatgtgctagttgggtgaccttgagcaagttgtctgaactctcagtttcatcttctgaacaatggatgagataatagtatctacctcatacgatcattccagtctcgtgtgcctccctgctgttacctctgcctggaatcatctcccaaggtacctgaatgatcagctgtctcacttcttggactgctatgccagtttcacctttgcggtggagtccagaggggccgcattgatatcctagcttctttctcttcattatatttaaaaccacgccacatattctatgtctatttgattactaattgtcccatctcacccccaataatggaacctgccttatagaaggcactttgtttagttcacttatgtgtcttctgtgcctagaatggagcctggcatgtggaaagtgcttaataaatattccttgagtggatgagctggaaggttaaatagattaatttatgtgaaatgccttgatataaatgttcaatgcaagttaatcattgtgttagttattatcactcttcagcacatgtgggaatcccttctgtgtgcccagtacagagacctaatgtggtgcttatcctggtggtggtggtggtggtcttactttaggaaggaatgccttgatcatcaggtacatgctgcgcacattgagattcatcgagaagtcccagtctttctcctcacaatccaggacagttccatgatggacaaaactagaagagtgattaaacaatggaagaataactgccattaaaatttttctattccatctgctgattatttttattgtcacttagtgacttagaccactgtctctttcccttatcaagactttaaacaattcatagtatcacttagtatattatattagtaagaatcccaacaacttaagctagaaatgtcatctgaaaacaagatccttgttttccaaacaaaagtatggtcaccgaacataagaagctttatattaattgtgctggaaacatcaatgccattaaaaacaaacaacaaataaaggcgaacagggctaggcatggtagcacacacctgcagcctcagctactttgaaggctgaggcaagaggaccacttgagcccaggagttttaggatgcagtgagctatgatcattccactgccctctagcctggggaaccaagacaaaccctgtttcagaaaaaaaaaagagagagagaaaaaacatctgccctatttgcctatgtgattcctatttcaagagcaacagtgccctcaggtggcacagatttagaattctcaagggaaatcaaaattgcaaggaaaacaagtgtctgaacatctcagagcagcaaagtgatactgctagtgttctaacatactgagagatgttagtttgttgtaagagagacgttaaggcagaacaaaacaaacccgtaaagtagctttcactatttttcaagttacgttttctgagggaagcttccaaaacactggaacccttactgatttggtcctctggacccaaattatgtaattcattataaaatattgttggctgtgacttccatgtaccaaagctctgctatttcagtcagaatgtcagtttcatgacagcaggaaccacatgattatttctacatcccctacatggctgaaaatttaatagatgctcagaaactaactttgctaactatttgtttcatgtttctgggtgtattcttacatgaggatggaagactatttataaaatagatgatcagaaattattgctttaatttaacttccatacattgtaacacataatacagctttgtatcagtaccatctgtcttgagtagacctcatttgccccagatcatgtcaaactctaaggctgtcttacctgctgaattttatgtgtaatgaaaatgctgtgtaaaatctagccatatttcccaaggaatatgtcatggttcacaatgaatgattttgccacattatgaaaattctttgaatgaaagtcatagaaaactttctgtaaggaaagtgaaactaaaaagttatgaattacccagcaacattaaagagaacatcaagtctctcaacttcattggcaaactgatcaatttgtttcttctttgtgacatcaaggacacgagtttgaatacctgaaaaataaaacaagaggcactattcctaaaaatgtttagccttgaaggtttagctgttttgaagtgtgaagtgtgaagattgcaacatctatccagctaggcttcatagattgctgaccttcttactagggtcttaagaatcttcagagtctcattagtaaacttaaagtccatcttgactcctccaataacccatccgtccctcttccttcctctctgtccattttccaagttgaataataagggtcctttctgagcaatggctttatagtaaagaatgactggtgtacattagatgtttctcagtaagccagcagtaataactgaaaatgggctcatttgaagttcttacaaacttcaaacattaattttctcctctttgcagcttttctcttaattttctcttctttgaggtataattgagaaataaaaattgcatatattcaagatgtccttcccctatccttcccctgccagagactgggttgctggtacctatacagtaatcagaattttgtctgagtgaggggtggagaagagcaagtgttctggaataagagactgtttctatttgtgagcttcccctttatgtcatttccattatttattagaaatgactctgttagtcaagggtatccagtcaaatacatgtatttctggactaaactgcaaggagaagaaatgagagggtcagaagaagggatgacacccttgaaggctagacatgagagatctggcatggcgggcacctgagagatacacactgcactagttgctgagaaactccaaacagtgtctaacaaaagcagcagtcatcattataaatatatacacatattatttataatgtgcataatatatattataacatatagtaatataatttataatatatacaatgtattaatatgtatacatataatatataataatatatgaataatacatataatatatagtaatataatttataatatatacaatgtattaatatgtatatgtataatatataataatatatgtataatacatataatatataattatctataatgtgtattatattttataatttataatatattataaataatatgtatatggtttattttgggggaatatagaaataaaagattcataaagaaagggaagacttgaaattttgtttcagaaacatttccttatctttgtgcttccccagtgcagcagctttactttgacttgtttgaattataattcaacatattccaattcaattaactaattcaaggaactaattgctgtttgattatgtaacctgttctattttgctgtaagggttacctttcatataggttctctgttctgatttctttgggtaaactgcaattaaaatcctttggtgttggagtttggttcagtggggtgaagaagtggtggtacacacctaataatctgggtactctcttagggtttctcatgatgatgtgtgattttagagctaagctgtctccagccacatgtggctactgagcacctgaaatgcagctagtctgaaatgaaatgtgctgcaagtgtaaaatacacatgaattttaaagatttagtatgaaaatattgagacgttggtcaaagggtacactcttgcagttataagacttaatatacagtacagtgactatagttattaataatgtattgtatacttgaaatttgctaagagggtagatcctaggtattcttagcacacacatacatacacacagaggtaactaaatgaggtaatggatatgttaattagcttgactgtgataatcatttcacaaggtattttacaacatatatgaaaacatcatgttgaacatcttgaatatatgcaatttttatttctcaattatacctcaaagaagagaaaattaagagaaaagctgcaaagaggagaaaattaatgtttgaagtttgtaagaaacttctaataatttaaataaaaaatttagtaagaaaaaattaaaatattaattttttaacttgagtgcatgttgagattatattttagatatattggataaaagaaaatatattattaaattaattttcacttgattctttttacttttttaatgtggatactagaaaatttaaaattacacaggcagctcacaacatgttactattggacagggctatcctagaggaggagggcacagaagtgaaaagctgtcatgaaaagttaacctaacaactagtaaattttcacatgtaagtttgtaattaggaactgaatccctcaaatgtgttagctaaataaaggattttaagtattcgtcctcaaatttttctatgcatgtaagtcacagatttttgtctataggttcacaaaatatagatttcatatcagagagagaatctaaaaagcacggcagtggagctcagtagctagggaattttctttcaacatgtgagcgccatgctttataataccttgcagacactgaatcccaaattcaagctgctgagttgcttacccgggtacttttccagttcctgaagtttggactcattaatgtctgtggctatgactttggcaccttctcttgcaaaagcctagtagacacaaagtacaaataaatcctttgtttacttgaataaactgtgctcatgaatggaacatcatgtggtctttttctcctttatcttattttcattgttcttttccctataagatagctagaattttaaactatctagtcttaccccttctccattgttattatttttatcattaattagaacaatgtgacatacattgtgcttgtcatctgacttagtccctttaagtaatatcaaacaaaataacgttcttaaaaaaatgacagctgttttcaatactctcaaaatactgctcttctgtaatgagactatatatcatttctgagtttgagttactaaactccaaataataagagaaaaattggttgtttcaacacttttcctactaagagtatgctagtgctttcataaatgtcaaaccataccctgccattatacttaaggtactgttatacttaaggtgccgatattagcttaagtggggtacataatgtaacagaaattgatataaatcaggagaacaaggtaacctgtcttataactctggagtcatatatctaaactgacacaatttcagaaagctgtgtaaccctgtttgccctctgtagcgaatatatcatgatgcagagaaactgaagtagagaagtttctcagagtcaatggttatcagtgatgtcatgtactaaatatgaggtattcattccttcatctgcctggggtcaggagtagggacctatttatttatttgtttatttttataacttaagacaacagaagcacaaaagtaaaaaaataaaaaagcagagcagaagtaaacaaccatggcatcagtccacataattcaatatgtcaagagttagtaggcaaacaacaaagatagtaacttataacttactaaggcagctgcttggccaatcccctgagcagcggccgtcaggatgatgactttcccatcaagtcgacccataatggaacctgtggtttaatctaaagacatgtgtgtttaatgggttatactgtagaacatgatcttgagcaggcagtaacatctagaatgaatagttcagtgtgctcttttaagaataatttagtgagctccttcaggaacttgaagacagcacctctgtgcaagtagtcccatcatctgaattctcctagaatgcttactctgcatacctagctttgtatatcaaacacatttaccataacccactgaagtaatgactggtgacagacattggccattttttttttttttttttttttttatgagatggagtttcactcttgtcacccaggctggagtgtaatggagtgatctcggctcactgcaacctccgccttttaggttcaagcaattctcctgccgcagcctcctgagtagctgggattacaggtgcctgccaccacgcccagccaatttctgtattttttgtagagacgggctttcaccatgttggccagactggtctcaaactcctgacctcaggcaatccacctgcctcagccttccaaagtgctgagattacaggcctgagccactgtgcccagcccagatattgcactttaacctaccttatccttccttcagtacctggagaggacagcctctggtgctgagtttcctcactaccaccatcactctctccatgacccctgcacacattgctatgacattatttgtgtccttactactcagggctgcttcttgatttctcttccataaacttttgttgaggtttgcactatcaattgcttatgattttttttctcttgaaaagatttcatagttggtctcagatattcatcgaaaaaaaaaaggatggaaaaatcaaatcacatccaatactcccattttacagatgaggaaactgctgaaacatgcccaatgtcatagagccagtcaatgggaaagccagaactaaacttagacttccagactcttgctatgtgaacagtccagcccacaatgctgccgatcctcttataaagtttaagcatgcagtagtaacacattaacaggcataatcagtaatttctaaatgattgagaaacactgacaccggggctcatgtgcatgagatatttcaccagtgcttggattatagatcacaaagtgagagaaagagctagtagtgaggctgggggtggagaagagccaaatgaccatcaaatgaggctgtcttcaaggacacaggctccaagtcttgctgggctctgtcattaatgtgtgcctctgacctcatacgaactcacaaagtggctgctttgtccaaggcatcatatccacatttcaggcaaaaagaaagggaggagcaaaagccaaaaggctttcagagaggtctcacctttctatttaagaaggaaaccttctcagaaattcccacctgcagttcattcaccagatctatgctacttggccactcctagctgcaaagaggttggaagttgagacttttgtttccagctttgataaagtgaagaataggagaaagtgagttggatggtgttgatgaaccaacttacagtacatgcaaactagcctacacaatcactctgttccattatctgcctgattttgtacaggttgatagccttgcctaaagggcttatattacctagtcctttctctttgaacttatttcagttctctctttagccaaacttttttttttttatacccaatatgctcttccatttcaaacctccacacttggtccaaggtccacatggtgaagggcaagttactcctataggcaacagccactgaaggatttatggaaagggtgtgaaatgatcagattcgtattttggaaggactgctgtggagaacatacctgggcaggagcatggggtgccattaggaggctgctagggttatctagtgggggcgctggtgaaatagcagggctggagaaaatagcagggatggagagataggtggattggagaagtgtttcagagatgagataggtaggacctgatcaccaacgtggctaatttcaaagaaatgttatttgcccagtgttttgcagctatgaattcaaacctaggccttcttgttgcaggtccaagggaagatctcatggcattgtctcatggtactcaaagccctgcgggcctctctaaatccccactgtggcaccaggagcctgtgcctcgcagaccgctgaccccaggaagtaatggacaatgaggcgcagctgctgctgcctctctgggtttgtgctgaggccaccttctcggggccgttacaagccagtgcctgagcatgcatgcttactaaggcagactcatttctgggagacatagacctcctccccaacggatgactggctagagaagctccttattaccttgctgaagttctcttagactgcacagctgtctgggatgcttccactcaacctggtttccttcttttcctccctcgcgggtggacttgcatcgaggtctgatggctctcacagccttacctagttctctcctcattctctctcacaacagcatttcccctaataaaatccatgcatatttaattctatcttggagtctgcttcttggaggagcagactaacacaattatgtaagaactggctccagggatcagcttataatcactgacttcctctgagtttgtccacattttttaggcgatggggaagcttggctttaacagtgcctgacctactttgatgcaatgaatttttgcttttttacttcttacacaaaagataaacatggaatgtttatcatttcaacatggaatgacagtttctaaagtataactttagaaagatatactttatcctccttgaatcctaagcatggtgcacaaaagctattttacaacactgtcattagtgatattgggtgtatggccctgtaaagcctccagtcaaaggttttgctaggaatctttgccaaccgaagaagcacttccagaacaaatgccgaagcacagagcagcctttctatgcactctgaaaacctcctcttagctggccttcctgtctttctgggaccagattttggggtcaaagccttaacatttgataaactgtaatctcaaactaaaacagatttctttgagaaaatgagagcaaacacggcctgaaatggtaaaacaaggcacctctcaatatatccaatgtgaaaaccatacatgttggcttccttagtccaaaagttagaatcaaaatgttgatttttgattagcagagacacaaacagcatattcaggaagccattgttttcaagagccaggaagaaaactcttcacttaggataccgtaagaatccttttttcttgggctactttataaaacatacataccacagagtttcaggctctttaaaaacccatctttacactgatctaactgctcagattaattttgaaacaggcaacgtgcagaaaaaaacaacatctaaaaattaaacctcccctctttccgttctaaagtttcatttcaaaagtattaggaaatcttactttaagcagcgagctgatggcgttctccagaactcggtttgagcaacaaacttgagacaacctttgtctggaagcaagtcaagcgcttaataatgcatgctgggatttgtagtttccctgctttcagagtttagtggctccatccatacactttataaatgtatgtgctgccatctagtggaattcaggtagaactatgaattccaagtggaaggtgaaaagtggaaaagcaccttagagcttacttaggatgcggaaatcatttccttcacttcagtctctccacttctctgttttgtttatgcctactatatgcggtgccagggtagacgagattggctgagctggaaactgcgtgtggaagatagcagagcaacaaaatagagggaacccaggtcactgaaaattctggagccttcctgtcacttggcctggattgttttaagggagagaaataaaaaaaaaaatcctttttgtttgagatacagttgtgatttttattttttcatgctcagaatattctaacactaatgcacatttagtggcagaatgccaggagccttttactacactgggaatggggttggggagaacgtgaaacttggatgacagggtggaggcttaaaagggaacatgttaacagcgaaaaaccccagtttggctgaagagaacagagatataaggtcaaaaagaaaggactagatctcatgagccctctaggttaggatagcaacatgtgctttatctgtagtgccagtgagcagagtgattgtgtaggctacttgtacatgtactgtataaattggtttcctcagcacccatccaactcactttccccttttttcacttgtcaaagctggaaaacaaaagtctctacttcatagccttgtttgctgctaggggtggccaagcagcatagatgttgccaatgaaatgcaggtgggaatttctgaggagggcctccttcttaaatagaaaagtaagcccttctgaaaggcttttagcttttgctcctccctttctttttgcctggaatgaagataggatgccgtgggacagagcagccatttagtgagttcatctgaggccagaggcacacattaacgacagggaccagcaagagaaggagcctgcggccctgatgacagcctcaaggcaacaactcctctggacttcttatgtgaggacaataaactttagtgtttttcacgttttttgttacatggagctaagtgatttctaacagtcacaggggataagaacaaagactgtggcgtcagtaagactagagcaagtcccatatctctctctcactagctaagtgagtaaatcacttaaatctctgaacctcttatgtttctcatctgtaaaatgaaggtaaaatagcacctacctcagggatgtggtgaggaggaacgactaagcctgtgaatccatcagcacaatgtttgccacacaggtgcttaatacatgttagtgattcttatgatgaagacattgttggagaaatttaattataatggatggtaaaagttgcgctttttaatgttcttttaaaaactggacttagtttctgcatgtgtctatatgaggtctatggtaaaattgtccctccttgttcattgtttcagcaacttctaatgctggctctaacaatctgtaatcacatctagctttgttcctgctttactaataatgccctttgacttttgaggcttttggaacagactttatgagagttctctaatcaaagccaactccaatgcttcttgatgtagctttcttcagcatccctctgtaatcttcagcaacaatgcttacttgataacagcctaagtcacatggtattgcaaatacttgcttacccattagtattctcagcagactaaatttcttcaagggtggggactatgttttacacctttacattgtgattagctcgtattaaaagagtattagttacttgttttcttatctacaatatgagttccacattggtagtgcctttcagtgcctaaaacagtaattggcagatagtagatgctcattaaatatttgctgagtgaatggcagtttcttaataagtttcctgaatataattctgccaggctctcaagacaatgtttgtgataattaattttaggtgtcaacttgactggatttacggatccccagagagctggtaagcattatttctgggacatctctgagtgtttctggaagagatcggcattggaatcagtgaactgggtaaggatctacttcacccaatgtgggcaggcactatccaattggctgagggcccagataaaacaaaaaggcagagaaaaggtgaattctctctcttccggaactgggacatccatcttctcctgcccttggatacctgaactccgaccagattctcaggccttcagacttggactgagccacgctcctagtttccctggctctccagcttgcagacagcctatggtgggacttctcagcctccctaattgtgtaaaccaattcccctaataaacatcctctctctctctctctgcatatatatatatatatatttttttttttttcctcaagcttcagtggggttacatcccaataagcccattgtaaattgaaaacattgtcagttgaaaatgtatttaatatacctaattcactgaacatagagcttagccgagcctacttaaatgtgctcagaacacttgttagcctacagttggataaaatcatttaatacaaagcctgttttataacaaggtgttgactgactcatgggatttattgaacagagtacactgaacagtgtcagttgtttactcgtgatcccgtggctgactgagagctgtgtcttgccgccactgcccatgatcacagtagagtattgctatcttatgaagagatcagaattcaaagtaaagttttcactgaatgcgtatcgctctcacaccatccctaaagttgaaaaatctcaagttgaaccatgacaagttggtgaccatctgtgtatattctattggttctgtctctctggaaaatcctaagacagattttggtaacaggagaggttctagaggaacaaaattttaaggatgagtttcctgagttggttttggggttcctggaattggctcttagtctgattagatttgaaaatgctaaaggctctactctttgagatggggtcacactcttgaacaggttggagtgcagtggcaccatcatagctgactgtagccttgaatacctgggctcaggccatcctcctgcctcagccctccaaattgtttttttttggtagagatgaggtctcagtatgtagcctaggctggtctcaaactcctggtctcaagtgctcctcctgcctcagtttcccaaagtgttgagattacagggatgagtcactgcgcccagcctggctctccttttaatagtacagagagcactgattgtccaagaaatgaactgttcatagaggtatgcaaaatgtctgcattggatactcctaatcaaccacttcttagaggtgaggaacttaagtgactctatatataatacttttttttttttttccgagacagagtcttgctctgtcgcccaggctggagtgcagtggcatgatctcggctcactgcaacctctgcctcctgggttcaagcgattcttctgcctcagcctctcgaatagctgggattacaggcacacaccaccatgcctggctaatttttgtattctagtagagacggggtttcaccatgttggccacgctggtctcaaactcttgaccttgtgatccgcctgcctcagcctccctaagtgctgggattacaggtgtgagccactgtgcccggccctataatactttcaaatatttatggaaaactaagaaatataccaatgttggttggttgcttctaatattgttgggcaaaattatttaaaaaaaaaaaggatgacttcagggattcaaattcatggctcaagctccacataagtaacctaagagcttataggcgtgccctgaaagaggatcttctctcctgtagacatgaggctaaaattgctgaaaatcaaacaccagtcttcatcatttgattggtgcaattacaaaaggcctcagtgtgtctactggtaaaataagccacagtgactgggagagtgagattctataagttgggatggggacgtgtgggaagaccctgaagccaggaacattgagtttttttttttttttttttttttcagtttcaccctgttggccaggttggagtgcaatggcatgatctcggctcactacaacgttgacttccagggctcaagtgatcctcccacctcagcacccccgagtagctgagactatggccataagccaccatgccaggctaatttttgtattttttgtagagacggggtttcactatgttgcccaggctggtcacgaactgctaggctcaagagtcccacacctcagcctcccaaagtgctgggattacaggtgtgagccaccatgcctggccagttcctacattctgatgagtttttttttttaccagctgtagtggcctctccaacctcattggggttggtaatggcctttccacctttgtctgaagggttaaccctgcattgcctgaggaaataataatggcctcccctgaggcagctgccaagcaagacaatgctgattctcctcaggacctacccccaccacccctctatgctcctagacctataactagactcaagtcccagcagatccctaatgtgaggtacaaagtgtggcccatgaggagctgcatcacaatcaaaagaaccacttgagttttctaacttatataagcagaaatctgagaaaaatgtgtggggatattaagggtgtgggataatggtggcagcaaaagggacagagcttatttgaagaaataatggccacaaacttcccaaatttgaggaataaaatggacacccaaattcaaaagttaagcaatattctactaggctggctacctgacaactagatttttaatggctttaatgtagttttatcaatcaggtaaacaaccactactttgggttacttttgttcagtggagaagcagacataaagaatcaaacctgcaggcatgttagtgttttgtttggataagggtggaaagcagaagacagactctcaaggtacaggtctgggggaaaagattttaggaagggatagtttccccttagtctttgttaattcctttggtggtatgttaagatacggagaaatatccaatccacagactttgaaatactagatatgatgcaatcaataatctctccctttgaatgaatcttaccaaagagccgagaatgacttgaaatcactttacctctgttctataacctaatgcaacttgttttaagtggtttttcaaagtcatatggtataaaagtaatatcaaatatcctctaaaaccatagttcttagatttttacaggatcacgggcccctctaagaatatgataaaacaaagtataaaccccagtatcccctccccccaaataaatccacacaaaaaagttcataaaaaatttcaaaaattttacagattacaagaagtccatccatatatgctttatctatctgtggggactccaggtttagaaaactttactttgataaaaactctggtactgtttccttatgtctacaatgaagaggtagaataaatgatctataggttcctccaggctgggagtgaggggcaatgaaaaacaaagtctataataaaccaaccaatttagagagtttgtatagggattgggataggtaggttaccagaaatgtgagaaagaacttctgtggttattacagtaaaaggaatattagaactggaaagttaagaggacatagcctctgctatcctttaagaatttaaatccagatccagaaaacttgtgtatattttcatagcaaaatactgagtcaacaagagagactacctcaccaagaaaccattaacattatatagaagagcggtgattcagaactactaaacatttattgaatgtgtaaggtattaaaaacatttacaattttgttaataaaatgatgttttatattaatgtatgtattatgctttggaatatgctaagtcatgtagataactttacatttctttcaataactttattctttacaaaatatacaaataaataaaacaattcaacttttaaaagtattaccatatgcaagaagaaggtattgctatcaccattctaaattaccacaatgcattcatttcctgttcccttatctttcaactctagtggcaaagtaaagactgaattgaaattaagctgcactacaacatcattaccagggatagacacataaacaaagtcatttccaaataaggaatgctggatctccagagaagtgacaaagaggagtctactgagttttgcactcaggcacatccttgcctgaggaggcgtgccaaggacctggctgagaatccacactctctgctcctgcattttgcacctctgagaaagaaaatgaaaacaacattcatcctattacaaaaatacacaaaaaccaagcacagctggaagtggaaaggaggttaagacaggagagatgtgaagaatgaaaaatggcaacgtgattcaccgtgtttggtcatgaagatggtgtatttcacctcagagttggagaagtttactccccattttgtcctaaaatgaactattagacaaaccatagttaaactgagaggtaataaagttttatttggaattcttcaatttgaaattcaaagtgaatcaaacacgggctgattgagttttcttttgtcctgtttttcaaaataaatggtgtgctaaacaaatagtattttagagaatatttaatcatctttggaaagctttctgtgagcctttaaaaaggactttagctgcatctatttgcttataaacaatatttattttacaattattatatttataaaagtaaatctaccataactggtcttggcaattaccttagtttaaggtaatttagattaccttttataattaaaagtaaaaactcacatttatttttttaaagactggtattaattcaagctgggactatctcatttaattctgaattggtcagtttttgatttatgtattcttctaggctactcttttatttatctaaaaacagtaccagagagatccacatattaaaaaaggactcaaacatttttatttgcagtttgatgaattcacattatgcatatgcctctggcactagcagacaaaatcaaaaggtgattacagctgggtgtggtagctagcatgcacctgtagtccttgatgcttaggaggattgcttgagcctaggagttcaaggccagtttgggcaacatagtgagagagttccatgcaagtgttagctagccaatagaaggtccttaaatgtttgttaaatactatttaatgaagagaatatttcaaacatgtttttattccaaatgtttctgtgcctacctatctccctaagaacacttttagactgtcaacttgatctaattttgatgtagttgatgagaatggatagattttttcttaatcacaaagtagaggtttataaactctggcaaatagtgctcaaggttttaaatgatttggcaactgcctttcttactgtacaattttgttgctttagatttctacagttgcataacagggtacctctggtagggtaggcagacacactgtcacaaagggctgtgcacagtagatgctatgtggtgagaaagactacaagaaatgccgtgttaccgtttctcctgcaagtccccccacttctgtggacaacctccatgcagagctgggggtgatccttgatacctccccactcctttgttcaatcaggtgcctggtgttgctgattttactccaaaatctctcccgtcggtctacttctctccttctctactccaagtccacactaccatcatgtcttgtttagacaacagtctaactcctgctcctattatttgctggtcaccttagagacgaggtgatgttttcaaaatgtataactcatgttctcctgccattgcttaagatctttcaaaggcttcctctacacaataaatgaaacaattcctttatataatttataaaagtccagcatttctggctcttatttctctctttggcctcactgacttcacccacacaagcttgtactcactgtgctctgaccacaccatatttctttcaactcttcccctggtcatgttcccacctaccctaacgctgttgctgttccatctgcctgagatgtttttccctctgctctttattaagataactcatgttaaccttttagatctgatctgtttccttcctcaatactcctcaaatacttattatatttctcatagtcttttgtacttgcactgctataatttcacttttttttttttttaatcacttgattactgtctgtatcttccatgagaattaagctctatgaaggcagggatcatgtctggttttgcttatcaatgtgccaccaggatctaatccttaacacatagtaggggctcaaaacaattttattgactgaataaatgaataagtaaatgattcatctattatctggcttgggtaaagtaaatataatgctattggatattttggtccattgaattgataagacttttcagtaaaagttgctttttagggtagtatcttcatgtccttgagaaagttgcttgtctctctttggacgaaactaaaggcttaaagggtagactaaagacttcacttggggtaaaagtgaattgcacttcactgtgtggggtgccttggagaaatcaactttcttacagagtcagcaaatgaagcctgtcattgtagcttactcaactaaatcatctcttatctaaacttgccctttgggatcacatattaatgataagttccaactgttaccctctgatttccaagtaaccagtatatttacttacctggacaaaggcctaaacttgagttatcaaaatagcgaactggatgaggtgatggtaaagactttgatcggctatcaaaaaaacaagattttggtgattcctttggcacaggatcttgtaaattccgttccttgcattgagagggtgtaatttgtttctttttagaagctgttccagtcactttaggagactttggagaattctcacaagttacttgtttgtgagcctctcttttaagggttctttccttccaagttttgacctcattggaaagatgctgattattgcttaaatgtgggggaagaaaagagagactgtaagacttcttgattcttaagatgtattcacatttatatttaaaaattaaaaataaattgtgatgaaatatatataacataaaatgtacattttatcacatttacattttaatttcaacctcatgcttcctgttttgactattttcaaagttcagaaaacaaaatggatctatataaattgaataatatagtaagtttccatgatcatggagtcttgaaaagaaagctctaagtacaacattaggttttcaaatgaatcaatgatataatccagagtggcttatctattgatgctttgccacaataatttgacaaattagtctcctggatagatgaatctttgatgtacctttcttactgtaaaataaatattacactgtgcttttctagttacaatgctgcttcttacaggagatgccaccagcatttatccagttcctccggagagaaacctgggaagcaatcctagagacctcactctcttttattttaagtcatccaagtctcttgatacactctcatcctatctatcaaattcacttccttgtttttatccctattggggccaagctagtccatgctaaaattactttttgtctgaactaccataaacacattctaaaatttgatccctctataatgctctagcagccaaagatgctatatgatctcatcaggccactagcttaaaaccctccagtgcaggtaatcctgccattacatttaggataccactccatattcttcaaaatgaactataagggcccatgtaatctgaatctagttacctctggcaccttgtcttgcactttactctgtctcattctctacattctggccacactggatgtctttcagtcccaccaattagttattcttcttaactcaaagcccgtgaacatgttcccctggcctggaaaacttatccttcttccctcatctagcctaattcctactcatttttcatatctattctgatataggcataccttggagatattgcaggtttgtttccagatcactgaaataaagtgaatcgcggaaatcttttgggttcccagtgtgtatagtagaaagataagtgcaataaaacgaggtatgcctgtttgttggcttcctgatcaaccaaccctccacccctaacacctagataacgttggatctctctctttcataatataacccttttataatgtcctttttgtttttgtttcttttttaatagcactcatggcagagttagttatttgtaaaattatttaacgcttttttttctactgtatcatagtagagtgcttggggaaaagattctactcttccacgtggtagaagccgaataatttgttagatctgtttataaagtaaaaagcctacaataatggacgtaaggagttcctctctaagtaaagcctcactggcttgggtatatggacttgtggtgtatttcagctgccccctcaaaggtctttgtttctttcctatttcttgccttggttaagaattggtcagttgatagacagcaaacattggaatagtgctaccatattctcattttttaaaaaagatacttattacctgagctctaaaaattactttccccataatgactgaagtgttaccacctgcaaaaaatacgtgcatataccatgtccctacatatatgtaatagccgtaagcataatatccgtatcatgtaagcagatcttaccttaacaattcattcttttgttttattagctgttcattttgctgctttaacttagaaatttctttttctagccttatatgttcacttttcaaaataagagcttttgtgttttgtacaatgccgctgccacctccacaagttaagggtttatttgaaggctgaggatcagtatgttctgatatcactgtgggaggaaaatatacaaataggtgataattttaattgtctccaaagttcaaaataaaggaaatactaccaagtacaataagccattatagagacccaaacagctcaagtcttatttccctggaagtcacccttgacttctgccttctaccttactccctctgcttatttgaccaaccattaattctatgcctctagaatccccctcaaccaattccactaacatatcctgatcctgatcaccaagctctttcaccctgactgcagcaatagcaatcctctccacttactgctgtcctttattgatctatattttctacatcagttttcccctgaagggcttgttacaacacactgcgtgtgtggcggggaggtgaggtagggtgggagggccaccccgtcattcagtgcattatatgtattcaatacatattattaactaaatatatgttacaataatattaaagcacatattaaatattctacactatgtgtgtaaagagactgtgttttgtaaattgtaggcaaagttgcacaaaatgtgagatagttatgaagtggattaatccattaggtcactgggaattcacaaaagagggatagtgtgtgtgttgggggtgattcttgatgtctattttattttgaattcatctacactatgtacctgaaagtcatctacaaatcaagaataaatatcctcaaccttctgaaacaaagaatcctcacttctatttttacccctttaagttttctcggtaggtgctgtggttatcctgtaacagacactagggaagtttaagctacaacaggtactaggtaacaccttaacacctttagcaccatctatttttggaaacaagtggactataatacaagcaaatatcatcttatgttttgcttagtatttggaattttcaatgtgtttttacccacaactttcggtttgatctttatgtacgtgtgtgtgcgtgtgcatgtatataaataagtgtatatgtatatacacttttttaaaaaagacacttattacatgagctctaaaaattactttccccatgactgaagtgttactacctgcaaaaaatatgtgcatataccatgtccatatatatgtgtgagcataactatatatatgtgtgcacatgcatatatatgtgtatacacttatatgtatcctgtaacatataatatacagaattctatatattctgtaaatatataagtattatatataatatatattgcatattgaaaattccaaatactaagcaaaacataagatatttgcttgtactatatacttataagtgtatatatatatacacttatatataagtatatatatgtaagtatatacacatatatacatgtgcacgcacaaatatacacttacatatatatgtatatacttatatacttatacatacatatacttatatatacatatctatacatatatacttatatatactaagtatacttatgtatacatgtatatatacacatatacatatacatatatacacttataagtatatatgtgtatgtatgtatatatacttataaatgtatacatacttataagtatatataagtctgtatatatacttgtaagtatatataagtggatatatacttataagtatatataagtctgcatatatacttgtaagtatatataagtgtatatatatacttataagtatataagtgtatatatatacttataagtatataagtgtatatatatacttataagtatataagtgtatatatatacttataagtatataagtgtatatatatacttataagtatataagtgtatatatatacttataagtatataagtgtacatatatacttataagtatataagtgtacatatatacttataagtatataagtgtacatatatacttataagtatataagtgtatatatatacttataagtatataagtgtatatatatacttataagtatataagtgtatatatatacttataagtatataagtgtatatatatacttataagtatataagtgtatatatatacttataagtatataagtgtatatataagtgtatatatatacttataagtatatgtgtatatatacttataagtatataagtgtatatatacttataagtatataagtgtatatatacttataagtatataagtgtatatatatacttttaagtatatgtgtatatatacttataagtatatataagtgtatacatatatatgtatatattagaaaatccttcacagcagttctgtttattctcctgtaaaaaagtatgtatgagtatataagtacatatactcgtatatatacttctatagacttataagtataatacttctaattatataagtatttactatatatacttatatattacttatatatattacttacatattacttatatataatatataacttatatattacttatatatgttatacttatatatattataatatatattatatataatatataacttatatataatatataatatataagtaatatatattttatattacttatatattactcatgtaagtaataaagaagtaatagatatattacttatatattatacacttatactatatatacttatatatttattatgtatacttatatatgtataataagtgtatatatacttataagtgtatatatacttataataagtatatatataagcatacatatatgcttataagttagaaggtcaggtgctaaccccacgatttcatatagccattgagatctgcatcttagttcagtacttgttctactgcgtaaagctatctcaagtactgttcaagcattctttcttttcaaatggaacatgacagacagaatatgaataaaggtagtttgaggaatgcatgtatattgagaaatttgaccaacagatctaaaaagtatctcagataaatttcaaagacctttgcaagtaaatattaacttggtatttttagtttcaagaacaaacagaatagtatttatttttactgtacaccaattataacttattagatgcatacaattaaaatctacgaagacatgtgtttcgttttattgggaagcataattccatgttgatatagtataagtcattcctttattgcctgaaggtatcttcactaataggtaaagatttgacaatacaaaagcagagttcgtatttttcaagaatctataatggataagcatctaagattacaacaaacgatgtcacaagatatctggaaatatggttccaataaattcatttaaaaatagattagtggccaacttctgtttactctcgactgtcacatactacataatattagtcttcaaagtctgttgtgtgttgagaagtaaaatttcatctgaaaatatctgcattttctacttacctgaggtatcttgggcctgttgacttcttctgagattttctctcaatagccttataacttccttttgatattctacagtggcttttgtagcactgattctaacaaaaacaataaaaatatgtaaaaagctcagcaactgattttttacaggagaataaacagaactgctgtgaaggattttctaacacatcacattgacataatgcctgtaagtggcagtagataagccctcgtgatacctctctggtgccatgtgccttatggcattaatgccatcaaactagaagcattctgcttgggtgcagggacagtccgattttcttatattgagaaaccccagttcttttaaagcttctggaggcctaattcattgtatattgaacaaaattataattacctaattattttttaccatggggtcctagaaatatttgaaggtataaggagcatgaaagagaaagtgcagctttatttctgtatggtcaggaaagcaaaccctgactgcagctctggtctaaggtgctacaaaggtcaaattctgatcactgttctccagtagaaagagacattttatgagttgttagtttacgcattaatcagtaacgataaattataagactttctgcctttcttaatgactatgaattatctgtatctgctgaccctattctttacttttcttttctttttttttttgagacgaagtcttggtcttgtcccccaggctggagtgcaatggcgctatctcagctcactgcaacctctgcctcctgagctcaagcgattctcctgcctcagcctcctgagtagctgggattacaggcacctgccaccacgcctggctaatttttgtacttttagtagagacggggtttcaccatgttggccagactggtctcaaattcctgacctcaggtgatctgcctgcctcagcctcccaaagtgctgggatcacaggcgtgagccaccgtgcccggccctgctgaccctattctacaagtaaaattgtttttataattaagaatctaatagatctatgtttcactgaaaccaatagactgcttagagagcatgaaaattccaatgctacttcctgggcaaaataagagatcattaaatatttattcaagatttatataggaagaatgaaaagtgttaaaagccaggaagcatcctaacaaatcctctaaataaacctttccttattgattatgaatgcgaggaccagagagaataaacagtgtaaggtgatgcattagtaagtgagaacatatttctttttttttttttttttgagatggagtctcactctgtcgcccaggctggagtgcagtggtgcgatctcggctcactgcaagctccgcctcccgggttcacaccattctcctgcctcagcctcccaagtagctgggactacaggcgcctgccaccatgccggctaatttttttggtatttttagtagaggcggggtttcaccgtgttagccaggatggtctctatctcctgacctcgtgatttgcccgtgtagccctcccaaagtgctgggattgagaacgtatttctacttcagtttccttgactctctttaatgttcttttcattatgctataccacaaagaatttaggcatgctgttatgtataatgctacctataaataaatcaataaaaagaggatttgctcttgggccctagggaactataaactaaaaggaaatataatcttcacacagaaacacagtaaggccaacaaatgaaattaagagaaccaacagaagccttagtaaaactgctaaatacacacacacacacacacacacacactcttaatgttcactttcaggcatacaaaagccacttaaaattgtttatattctgtatgactaagaagtgttcaaagacacagcgtgttaattgatcagaattgtgtttagttttaaaaactttgcatatgtaatgagaccagtatatttaaaatctatggatgtgtacatttttaaaaaaagagctgtaacaatattttcataaattatattttaaaaagttaactaatgaaaagtatatgtagtttaggaagaaaatttaagctattaaaatcacattaaattaagacaaatacgtactccttttcaaattctttggcatttttcattttctctaggtctattttcacaagcttcattttgagatcttcaatttcttctttatatggcttagctcctaaagcaactttgtcctaaattttttttagagaaaataaaaataattattagaggcgcttcagtttctccagttgtaaagaatggttagctgtctttgctctaataaggacattttaaaatagcaaacaattccaaatatatgaaaaagcatcaattttaactgaataactagatattgatatgaagtctatttgaagctaatatgcaattagaaacatgattttttatttggagctatcataatatgcaattagaaacatgatttttatttcttaaaataaatattttttttctaattgaaaatacctacaaaatgaaaaaagttggaaataatgaaaagggtggaaaaaggtaaatcagaaaatgaaacaaaaagatgttggagcagtgatgtaaacatcaaactagaactaaatttaagccacaaaacaaagcattactaagtatattttgtactgaaacagttccatccagtgattcaaaacactatattttacagcagcaggtttccagaaaaatggaatggaaaatactgggagttcctacatacccagtgtcccctattcctttttccccatattaacatcatgcattagtatgctgcatttgttataagtgatgaatattgatacattattattaaaatctataatttccatgacagtttatttgtattgtacattctgtgggttttgacaaatgtaaaatggcacatgtccatcattacagtatcatacagaatagtttcactgtcctaaaaaaccccgtgctttgcctattcatccctctcttctccattatccctggcaactgtttatttttttactgtctctgtagttttgtctttctaaaaatgtcatatacttgaaatcatacagtatgtagcctttccagattggcttctttcactaaccaatgtgtattaaaagtccactcattttctttcctttttttttttttttttttttttaagacagagttttgctctgtcacctaggctggggtgcagtggtgcgatctcggctcactgcaaccttcgcctcccgggttcaagcgattctcctgcctcagtcccctgagtagctgggattacaggtgcttaccaccatgcctggctacttttttgtatttttagtaaagacagtgtttgccatgttggggaggctggtcttgaaatcctgatctcaggtgatccgcccgcctcagcctcccaaagtgttgggattacaggcatgagccactgcgcccagccctctcatttcttttaattgctgaatactattccactgtatgaatgtaccagtttatccatttacccactgaaagacagtcttagcaattatgaacacagctgctattaacatacacatgcagccctttgtgtgcacatatattctcagctcatctgagtaaataccaaggaatacaactgctcaatcatacaagtatgcttagttttgtaagaaactgcgaaaccatcttccaaaatggctgtaccattttgcatttccactagcaattaatgagaattcttgttgctccacacaccagcatttggtggtgtcaatgttttggattttggctattctggtaggtttgtaatggtcgattattttaatttgtgattctctgatgacatatgatatgaagcatctgttcatatggttatttgtcatctgggtcttttgccaattttaagattgattggttgtttcctattgttggttttaagagttctttgtatattttgtataacattccttcaccagatttatcttttatatacagtttctgccagtctgtggcttctcttgattctcctgacagtgtcttttgtaaagcagaagtttaagtctcaataaaatccaacttaccagtttttttctttatggattgcacttcttgtattatatcttaaaaaatcgccaaacccaaggtcacttagaacttctcctatgtcatcttcttggagttttctagttttgcattttacatgtatgcctatgatctattttgagttaatttttgtgaaaagtataagttctttgtctttttttgcttgtggatgttcagttgtctggcatcattagttgatcagactatccttttcccattgagaagcctttgtttccatctctcccagaatagaaatgagagttcttaaaatagcttacagggcctttatgatctggtcctctgctacttctcaccttattttctacctctatcctcttgcttattctgctctggatgcacaaactttcttgttgttttcagtttgctatttcctttgcctggaatatttctccctggctacacagttcaccctatcacatccttcagatcatcttactggtgtgacattcctcaactcctgtatatacaatcatctctcttcccacacatgtccactttcacccagaaccatgtacccccttgtctggcttaattttttccatttcacttttcaccacttgagatataatatacctcttaatatatataacatatataaaaatataccttctatgttttacatttttaattaatattctgtctccttcaactagaatgtaagttccttgatggcatggtctttgttttttcattggcctctagaacagtgagtgacacatagctggtgctcagcaaatatttgttgaatgaataaaaactgtgatcaattatttgtaatattaaaaaattacaacattctaaaactttacagttgaatttttttagtttctagctataacaattgttgaaaaaacaaatttaattttttcttttgcctctctgctcatgtctcactgaatagaccagaatttttagaacaatgttaaataatgaataaagcaggcattcttgacgtgttcctaattttaactggagagaaaagacactggagcagaacagcaaatttaaatatgccaatttggatcagactcgagtagaagaaatgtgggaagtggctggaactaaaacaagagggagctgtaagtagtgattaatgagtgtgtgatttgtctaatgacattcaagttgaaaaacatttcagttacggttcttccccccaaaacaggtcagattcagcccatgggatatcaggtgggactcagtaacagaggcagtaagtaggaaaaaaagaatttaaaaatttacttatctaatagtattatatattttgataagcaatttttgaaaaatgaaaaaatatacactaaactataaacaacatgtatatcttaaaaattattcttccaacataataaaaataatattttatatgacaatatgctcctacatttcacttctaagttaagctgcttctgcttgagtactgaacttcagaaacacataggtaacagtaagttgttgtgagagggaagaatagagcacaaggagatttgctgaattcaataggttaaacaaacaaacaaacaaacaacttttatttttatgtttaagttacctgaagtacttgaattgtctcttttgttttttcaaggcatttatttgattcatgaactttggcttgaagttttgctattatgtcattagtcacctcaagttctttctgcatctttataatcttgctttccttatgcatagcactttctttagcttcatgcagtgaattttccagctctcgaattttctattagaaaaagcacacattcataagctctatcatcaagacagaatcacagtatagaaatttgagacagagatgatcatatttagatattgttaatttttcacagattgtattaacaatggatagaagagaggccaaacatcattcaatctacagacatgttatttccctcatttagatgatgatttttggattgaaaatgtcaaaggtttatattataatctgtctgcaaattcttaaaacatgcagttaaaaacagcacagtggttatgcgatttattagttagcatagtgctaagcatattaaataggcactcatattttacatgaacaccacttaaacaaaggacattggttaattgactctctaaagtaatatatatttatctttccctttaattttattaattttttttttttgagatggagtcttgctctgttgcccaggctggaatgcagtggcgcaatctcgactcactgcaacctccacctcctggattcaagcgattgtcctgcctcagcctcccgagtagctgggactacaggtgtgtgccaccacgcctagctaatttttgtacttttagtagagacggggtttcaccacgttggccaggctggtattgaattcctgacctcaggtgatctgcctgccttggcctcccaaagtgctgggattaaaggcatgaaccaccatgcccacccttattaatcttaaatagaaaaacacaaatatgtggaaaaaaattcaaagacatataatgaagagtaagtctccccatctcagacccccagttgaccctgaagcgatgactactaaactttttcaggtgtatccttccagaaattttctatctataaccaaatatacatgaatatatagtttctaaaaatagtatacacacaatatactaaatatagttctgctttattttaaaacttgagaacatattttttccagatctttccattatcaacacatagatctctcctattttttgttttcatggacatatagaatctcatttcataaaggtatcatataattcacatgtacacactcttttttgtttttggcaaaatgtctggatttttgggggcccatttagaattcatttttgtttaatgaatgagataggaatccagccttacttttttccagatggctatcctgttgtatcaaaataatgcactaagcaaaccatcttttctttctttctttttttttttttttttgaggcagtgcctcactctgttgcctaggctggtgtgcagtggcatgatcatggctcactgcagtatcgatctcccaggctcaagtaatcctcccagctaagcctcccacatagctgagaccacaggtggatgtcactgcacctggataatatattaaaaaaacacttttttttttgtagagacagggtctcactatgttgtccaagcttatcttaaactcctaggctcaagtaatcctccaaccttggcctcccaaagtactgggattacagactcacacacctggccaagtaaaccatttttttttcccactgaattgaatgttactgttatcatacacctgtactaaattctcatacttaattgggtatatttctgaaccctctattctgttccactgctctacttgtccatttttgcatcaaacttgtctaatgatagtagcatgtattttattatctgctagactattttctttggtcattgaagattgaccaactttccttttgcttctttaaattactatattggtagatggatttcatctttcctctattttatctgtagcagctgactgaggtctgtaatgccctacaaatcaaaacactgtatactagtgatctagttctcattaagctggtggttgatgttttattataagtatttattttggtaaaaatgataaattgtaatttactattgggttccctacaagtcgttttgtgtgctaacaaaatacaacattttacgcatgttgttagattcccgagtaagggtagttaataaggtaatttggttatcaaataatgtactggttcttagatacaagttaacctgcgtaacaatcttgttatattttttaacctcttatatttttattgtgattataacattaagcaatattaaatacgctgatgataatgagaaaagctgaattgctatttctctccaagctaatatttgttctgcatacggacatagatcacagttcaacagaaagtcacataatttggaaaacttttgtggtaattgtacgttaactggtagtaacttaaactatagtttatgaatgtaataatcaaatgaagctacaatttatgttttataataatatcttacataatgtctagctttataattagtttagttgaacgatagccatagtagaactactagtaaaaatcaagcccatcacttacaaaaataaatgtgttcatgttcagtaataagtaaatactataattttgctctaaactctgtgatgaagctgcaaactgaagaacattttataagaaattatatacctctgtggttaactgtgtagctcttgatgtaacatgaggattcttattgtcttgtgtggtaggattaacctgggcaccagatgccaaggaagtcttcaatgtttggtagtttttaaatagtttttcatttttctctttcagtgatttcaggtcctgttcccactctttggatatggtagcacttctttcctcaaactctgttgattcattcattatggcctattgaacagtaaaataccattatagctctaaaacgatttatagtagtccccacttacctgcaattttattttccatggtttcagttaccctcagtcaaaagtggtctgaaaatattaaatgggaaattccagaaataaacaattcacaggttttgaattgcacatcattctgagtagcacagtgaaattttgagtcatcctgctcagtcctgcctgggatgtaaatcatcctcttgtccagcatacactacttgttcacttgatagccaccctgattatccgattgctgctgtattgcagtacttgtgtccaagtaacccttattttaattaataatggccccaaagcacaagagtagtaatgctggcaatttagatatgccaccgtgaagctgtcaagtgcttcttgtaagtgagaaggtaaaagttctcaacttaataagaaaaaaaatcatatattgaggttgctaagatctatggttagaatgaatcttttatccgtggaattgtgaagaagggaagagaaatttgtgctgtttttgctgtagcacttcagcctacaatagtgtgtgataagtgcttagttaagctagaaaaggcattaaatttgtggtagaagacaagaacagaaatgtgttccagttgatgacaatgtgttgtaccagcaagcattgagcatctaggaagacttcagcaagggatcccctgaaaaaagtgacaccaagccctttactgcaagtaagatttattcatggattcaggaatacagaaggtcaatagtagtctaagactatatcaaaatgtctaggtcattcatattccttcatcttatcaggtaggcactgtatcatctcacatcataagaaaggagagtgcagtaaaataagatattttgagagagtccacattcatataacttttactatagtatattgttaaaattgttctattttattagctgttgttactaatctcttactgtgtctaatttataaattaaactttatcataggtatggatgtatagaaaaaacagaatacatagggtttggtaccatccatggcatcccctcgggggtggggggtcttgatatacatattttaaaaaaacttcaaaaaaccctagaattctaggacagtgtatatgctgaagttcattatttagaacattctaaaacagtactttaaaagaatgtgaacattctttgtagtttgcatcagtttctgaaatttcagatgttggatgtggatgatgacaataaaatgaataatgactagagaggattcatattgatctgcaagatgataatctcactttattagatttgtactaacatatgaagagaacctgaagaattatccaggttaaaatcattatatatgctatggctgataatgaaacattaactgatatctaatagcagagcacagctagaaacttaacaattatctattgtcctgcttcattacaaacctcaatgttaatagggaaaataactcactgattgttggtaattaatctgaatatcttgtatttctgtacagggaataacaatactcttttatattgaaggctaactaactctgaaattattgatatcttttttacttcctaattcctgcagattgtactttctgctctcatcatgaatgccccattagtctcatccctaacttctttgtggctttgtggtcattctaccaggctttgtggtcattctaccagatcttaaattcgtcgtgttcctgacaccctggacactccttggctctggactatgcacctcacaccataccaagttattaatgcctactcttatgtgctggaagaagccacatatacatgctgatccacatagtagaaatccctgctttctaatcacaactgggtctccagtattacaagaaaaacaacaaattacaaatagacatgaccttatccaaacattggttttgtgcctttctctactgattgtggacttctttgttttttcttgaaatagccaactgctatttggctagctctgactaatcaataaacaggatgaactttccaagcgaaaactttttaaaaaaggcattgttccttatttcaacaagattccaatatgatttgcagatgaaattaaattgtcagaaaagaactatccaaacatatgaactataaaatgtattttggaaactataatattaatctagctaccattgctccaatttaatataaataagcaatcttttgaatattacatgttttaccaatgaaacagagaagggattacttctgaaagcagaatgaatactgcaattacttttgtacccaccaaataccaatcactgaaatgtaaaacaagttaacaaactggtcttaagcaatgttggtccttatgactcagtacatttgggctgatcaccttgggaacaatgattaaaaaaaaaatcaaaattttggaatttctagtttagcattttaggtgtttagaagttgccagtccaggacgggtgcagtggctcacacctgtaatcccagcactctggcagtccgaggcgggcagatcatgaggtcaagagattgagatcatcctggccaacaggtgaaaccccgtctctactaaaaaaaatacaaaaattagctgggagtggtggcacgtgcctgtagtcccagttactcgggaggctgaggcaagagaatcgcttgaacccaggaggcggaggttgcagtgagccgagattgagccactgcacactccagcctgggtgacagagtgagactccatctcaaaaaaaaaaaaaaaaaaaaaggagttacctaacaaggaaaaagcaaaacaaatgaaaaaaatccacaactctgcttagatccatcagagaagtgaggtcgcagggcaaagggatgctccccaaactggagaggcagagaggcagatacagagaattacaacttagagcagaaaccctttgcaggaaccagttatggggtaggaaaacctgaactgcaatgatgaattattggagctcagtgtggcaactctgagagttaaaaacttcggagacctagtcatacagtggccgccacacttttgtattttaccttcaggagctctaccaagtcatcacagttaatattggagaaatccctttgtgagtctggcaggagaggagaaaaggaaccattttaaaacaaaacacagcattttttttttcttaaggcctgacctcagcagaaactatttcaccagagcctaacatgctggggttttgtcagggcctaatatatctggaggagggggaaatactaagtttcagctggctcttgccttccatgtgaaggcagggaaatatactccgcctgccacccaccacacacaccttgccactacattactaaaggcctatttgctacagttacttttacccagtaaatcatgcctgcttttcagcaaaaaaaattacaagacatactagagggcaaaaaacacagtttgaagagactgaataagcatcagaaccacaggcagaaatgccaggaacatgagagttatcagaccagaaatttaaaaaaaatggattaatatgctaggggccttagtggaaaaagcagacgacttgcaagaacaaataaacaatgtaagaagaaacatagaaattttgagcaaaaaaataaagaaatgctagagatcaaaaatgctcttaagagaaacgaagaatgcccttgaagagttcattagcagactggctgaagaaagaaactcaacttggaaatatgacaatggaaacttccaaaactgaaaagcaaagagtaaaaagactgaaaaaatccctaaacaacatcctagaagtgtgcagtaattataaaaggtgtaatgtatacataatgggaataccagaaggtgaacagaaaaagaaagagcaggaatatttgaagtaataacgactaagaatttccacagattaacaacgtacaccaaaccaggaatccagaaaactcataatgctaaacgggacaaatataaaaaaaaaaaaaaaccaaaaaaacccccgaaaaaaaacccccaaaaacaaaaaacaacatctaagcatatcatattcaaacttcagaaaaatcaaaggtaaaaaaaaatctttgaagaagctagaagggaaaaaacaccatacctataggggagtgaagataagaattacatctgacttctctgaagctattcaagctagaagacagtggagtgaaaaaacatactaacctataattctattccatgtaaaattattcttcaaaagtaaagtagaaataaagactttctgagacaaacaaaaatggagggaatttgctgtcagtagactggtcttgcaagaaatattaaaaagaagttcttcagaggaaaggaaaatgatatagccagaaactcagatctacataaagaaaggaagagcacaagagaaggaataagtgaaggtaaaacaaaaacttattttcttattcttaactgagctaacttatgtatgcttatgaataagtgaaatgaataacggcaatgatacaatggatgggagggagaaattataaatattttgttattataaggtacttatattatctgtgaagtggaaagtgttatttgaaattgggctcagattagttgtaaatggatatattgcaaactctagagcaaccactaaaacaagatagaagtgtagttgtatgctaagcagagaaaatggaatcataaaataatttaaatcataaaaggcagaaaaaatgtggaagacaaaaataggtacaaagaataagggcaaaaaatagaaaacagaaacaatatggtagatattaatccaattatatcaataatcaccttaaacgtcaatggtctaaatacaccaattaaaagaccgactgtcaaagcagatcaaaaaataagagctgactgtatgttgtctacaagaaacccatcttcaatataaggacacatagattagaaagtaaagggatggagaaagatacaccatgttaaaactagtcaaaagagatgaagtagtgatattaatttcacacatagcagagttcagagcaaggaaaactatcagggataaagggacattacgtagtgataaagacatcaataccccaagaagacataacaatttttattttgcatgcacctaacaaaaacgcattaaaatacttgaggcaaaaactgataaaactacaaggagaaatagatcaatttattatagttggagacttcaacgcctctctatcagaagtgaacagatccaccaggcagaaaaatcaggaaggacatggttgaatttaacagtaccatctatcaactggatgcaattgacatctattgactacttcatccaacaacagcatattatatattcttctcaaactcacattgaatatttgtgaagacagaccacattctggaccaatcataccattctgctctcagaccacaatggaattaaactagaaatcaaaaacagctgaaaaatccctggataattagagatttaaaaaatacatttctaaataacatacgggtcacaggagaaataaagagaaattaaaatgtattttgaactcaatgaaaatgaaaatatgacttatcagtatctgtgggatgcagtaaaagcagtgtttagaggaaaatttatagcattgaataccagtattagaaaagaggaaagacctaaaaaccaataaatgaggctttaaccttaggaaactaaaagtgaagagcaaattaaatccaaagtaagcagaagaaataataaaagtagaaatcaatgaaattgaaacaaaatcaatagagaaaataaatatcctaaaaactggttctttgaaaagatcaataaagttaataaacctctagctaggcaaactaagaaaaagaaaaagaatacaaattactaatatcagaaatggatgacaggacatcactatagagcccatggacattaaaaaatattaggaacaactcaattattacaacccacaattatgaacaacccacaaatttgataatttaaatgaaatggaccaattctttgaaagacacaatctaccaatacacaagaaaggcagttcgattaggcctatatctatcaaagaaatggagtcagtaattaaaaactttccaaaacagaaagcaccaggtccagatgagttcaatggtgaactctaccaaatatttaagaaatttaaggaaaaaactatacccattctctacaacctacaatctcttctagaagatagaaacggaaactcattctatgatgtcagcattattctaatactaaaaccagatgatgacattatacaagaaaactacagaccagtatctcccataaaaagagatgtaaaagctgggtgcggtggttcacgcctgtaatcccagtactttgggaggccgaggtgggtggatcacgaggtcaggagttcgagaccagcctgaccaacatggtgaaacccgtctctactaaaaatacaaaaattagccaggcgtggtggtgcgtgtgtgtaatcccagctgaggcaggagaagtgcttgaacctgggaggcagaggttgccgtgtgccgagattgtgccattacactccagcctgggagacagagtgagactccatctcaaaaaataaaataaaataaaataaaaaacaaagatgtaaaaaaagatgtgaaaatctcaacaaaatattaggaagtcaaatccaatcacgtgtaaaaatgattatacatgaccaaatgggatttatcccaggtatgcaaggctggtttaacattcaaaaatcaattaatgttccatcacataggctaaagaagaaaaatcacatgatcatatcaatggatgcagaaaaaatttgtcaaaatccaatacccattcataatttaaaactctcagcaatagagatgaacctctacaacttgataaagaatgtctacaaaaaactacagctaacatcatagttaatcatgaggaactagaagtcttcctgctgtgatcagaaacaaggcaaggatgtcccctctcacctctagttttcaacactgtactggaagtccaaattaacgccataagacaagtaaagaaaatacaaggtacacaaatttgtaaagaagaaataaaacaaaactctctttgtttacacatgacatgatcatctacatagaaaatctgaaggcatcaacaaaaatactcctggaactaaataagcaactatcgcaaagttgcaggataaaaagtcaatatacgaaagttaatagctttcctgtataccagcaatttacaagtgtaatttgaaattaaaaatacattaccatttatactagcaccccccaaaataaaatacataggcaaatctaacaaatatgtacaagatctatatgagaaaaactaccaaactcttataaaaaaataaaagaatcaaataaatggagaaatattccatattcatggataaaaagacacgatattgtcaagatgtcagttctttccatctataaattagaagcaatcccaacaaaaccataggaagttattctgtgaatagggacaaactaattccaaagtttatatggagaggcaaaggacccagaataaccaacacaatgctgaagaacgacgtcagagaactgatgttacttgacttccagatttactataaaaatcagcagtttccagatttgctataaatgaaagaacaaatagatcaatggaatagaatagagagctcagaaatagatcccacatagtcaaatgatcattgacaaaggagcaaagacaatataattgtgctgaatctggacttctacaagcgaaaaaaaaaaaaaaaagaccttaagaacttcagaaaaattaactcaagatggatcattggtttaaatgtaaaacaaaaactatggaagacagcataggagaaaatctagatgatcttgggtttggtgatattttagatacaaactcaaaggcataatctatgaaagaaataattgataagctagacttttttttaacattaaaaatctgcactctgaaacacaatgccaagggagtgagaagacaagccacagattggtagaatatatttccaagacacatctgataaaagaccaatattcaaagtatacaaacaattcttaaaccttaacaatgagaaaacaaataacctgactaaaataagggcaacagacctgaacagacacttcaccagaaaagatacacagatgacaaataactataaaaaatgttcaacatcatatgttattagagaattgcaaactgaatgagataccactagaatggtcaaatactacacttactacacttactagaatggtcaaaatcccaaactgacaacaccaaatgctgatgagaatgtggagcaacaggaattttattcattgctggtgggagtgcaaaatggtaccgcccctttggaagactgtctggcagtttattacaaaactaaacaaacttttactgtatgatccagaaattgcattccttgatatttactcaagagagttgaaaatgtatgtccacacaaaaagatacatatgtatgtttatagcagctgaattcataattgccaaaacatacaagccaccaaaatatcctttggtaggtaagtagataaacaggtacatacacacaatggaatattattcagcattaaaaagaaataagctatgaaaccatgaaaagacatggacaaaacgtaaataaatattactaagtgaaagttgtcaacctgaaaaggctatatactgtatgattccaacatatgacattctggaaaaggggctactatggagacagtaaaaagattaacagttgccagggtttaggaaggtgaagtgatgaatacaggtggaacccagggaatttttatggcaggatagtaaaattactctgtatgatactgtaatgatggatacatgtcattttacaattgtaactcatagaatgtactatgccaagtgtgaaccctaatgtaagctacggactctcttgggtgataatgatgtatcaatgtaggttcatcgattgtgccaaatgtgccaccctgatgtgggctgttgataggggagattgtgtttgtggagatggggtataagagaactctctgtactttctgctcaattttgctgtgaacctaaaactgctcttaaaaaaaaaagtttattaaagcacatgaggcccatctaaagtagctggccaggcttgtctatgactttaccacagttgctgcccatagcttgaaacagactcatgtcttacgatctctaaggctactcgtggaaaaggctcagttcttacagaagcagtgagaaggagaagaaaaagaggacaatagtaagaggattcaagatttcacaagtggaaactaaatattatacaacaagatttcgttaccttgatcagtatgaattgataaggaagaataatacattagaggaagaacacgttttatcaaatcaatttttttaaagcatatacaaataaagaaaatatacataagttgcccttttaagaatgaggtaggacaattaaagcaaacagcaacaaaaaagtagtacagcaaaaagtaatacttacaattattctgttattaaagaagttattcacttgacaaatcctatcattttctttctggatgccatttttaagcttttctatatcaaaacgagtatttaaccactcttccaaaaactgtgtcatttctttcctattacttagtacttgttgaaattcagtctttatgctagggaactcactttctgagaaatctttgagaatttcctgtgtgaaaaataagcgtcaaattgtttaaacattaggaaagttttgatccaaatattttatttatatatatatatatatatatataaaataaaaagagggcaatacctagtggactcttgcttttcttccttttaatatcatttcttaatattttaaagtaaactaagaaatataattgtaagttaaaactttattctagttatttgcataatataattttggcagtatacatgatgtaacagattgtacctattagaattaaagcttgtcaaaatgacaaatttgtgactaattgctacaatacctgaagtgcatcttaatttttattttttgagatggtctcactatgttgcccaggctgatcttgaacccctggagtcaagtgatcctcctgcctgagcctcttaagtagctggaattacaggcatgccactggggctggcttcatgaagtgcttctaaatgtagcttttcagtacatatagcagaccttacatacatgttgggaattggatgccagcctcacatagatgaatgcaagtaacacattccatgtggagttgttgtaataaagcggtttctgactcccagcatagacataagttttcctgtatctattgaggtctgaagagaggctagtccattatttgccagtctttatgtctggccaggtatcactctgcaacgtatttttaatttctggtaaatgaaaatagctctaagcacatgaaaaagtacctttctacttgataaaaaggcttaaaatctaactaaatccatttaaaataaattatacctcaatatgtagatccatattctggttcaatttgagatcccttaattctctggatggtacatcacaatcttgttgaaggtgctgtattttaattagcaattccttttgcttttccacttcatcaataaaatccatttcaaatttattgatggattcatgttgttcttcttttatttttgtaacatagcttaacacatacttgcagaaaaaaattaaacaaattggtaaatgaaaattttgtcacatgtagagaaagttttcatccttgagactatgaggtaggatgacatctcttatttacctatatcctctcacaagtgaggaaaagggaaagagcttctctctatccccagtttttcctcttagtatcttaggagaataactaactcccagacctataattccttatttctgacttcttaccagatatacttcttggatgtcttacaagtacttcaaattcaacatgtttaaaacgtaacatgatccctttctctacaagtcctcctttttctattgcccagtttttggctaattacattaccaatcacccaggtttcccagttaaactcatgagactcattttcaacatcctctcctgccaacgctgattgggtaaccaaaaagatgaagttacatgcctcaagacttccttgtcggccggacatggtggctcatgcctgtaatcccagcactttgggaggctgacgtgggcagatcacaaggtcaggagttcgagaccatcctggctaacacagtgaaaccctgtctctactaaaaatacaaaaaattagctgggcgtggtggcaggcgcctgtagtcccagctacttggaggctgtggcaggagaatggcgtgaacccgggaggcggagcttgcagtgagccgagatcatcacaccactgcactccagcctgggcaacagagcaagactccgtctcaaaaaaaaaaaaaaaaaaaaaaaagacttccttgtcaagcatatttagatatttggcttcaagagacaataatttcaatgccaaatgtctcatggacttcatgaataattctagatgtctgattaccaggatttgtggaagaattaccagggcccgaagggcaatctacccaggtagggcagataccagcttacttattcctcaacttccaccattccttaacctcttataatctggtctcttccttaactacccagttgaaactgttctctgacaatgatcactaatgagttctattatcaccacattgagagaatatcttcagtccatattctgactctctgaagtatttgccactcataacttcatctttgacatactcttctccactgatttgggtagcagtacttttgctagtttctctcctgtatctttgacttttccaaccttgaacccatgtgttgctcccttttctgctactgcctcttagacatttatcttttccagagttctgtttttatcccaaggctcttagtcttcattatgctttctggatgatcttacaaatgtattatctatcacctatatgctgatcagtctcaaatgttagttcttatttttctcctgccaaacctcaaactcaaatctaaatgtctacttggtttctcttcttggatgttccatcataggtatttcagcccccaaacatctcaaattaaacaatctcctgcctcatctaccttgtttctctttcttttttatttttgaatctcagttaatggtaccactatcgacaaacctgactaagcccaaatccaagaactccatctaaacttctctcccttatgtccactatcaattatttcgacctactattttaagctgctaaatatttctttaatctcgtttgtcctctccagccctgtgaaaccctccctagtagtacagtcacatataatatctcatctggaccactgtaactgcctcttattgctttctgctactaggcttatctccctcaaactcatttcttctgtattctttagtttagtacctaagtggtaatcagatcctgttaccaccaccacttaaaacaatagtctaatgattccccatctacaaaaagaactccaagctttgttattgagtctggcttctactacagtttcatcttctgtaattttatttagtacgtcatataacttgcatacacttctatcattgcacttaatacttgtttatatgtctgtctcaccccagactatgagatctttgagatgttaactcacatctgcctcctgaacatcctgacataatgtctaggcccacaggcagagttcaggtgttgctgatatcctacatattactatgctcagacccacataatctttaatttggtagtaagaatactaaatagcaaatatgccggcacctgaagcaggacttaaatacattgatgtttataactgaaatatttaaaaggatattactaaaaaagatggtaccttcagtttcttcatgattctgtggaattccatggagcatctctggtttgcagtaaaaagtttttcaatgtgtttggtttgtaaatagggaagtgagaggtttgctttaactctcattgaaagctctttttggaattcaatttccttctccaagtcaagagacaatctattcaagcactcataatgatcatccatctctgagtatctcttcaaaagctcctaaaggaaatgagaattcactcaatttataacaattcattctaatatcacaataagtagttacaactctagaattgtaacaaaacttatgctttaacattttctgtaggagagaaataaagacctttgtgtctaaaaacaaaaggaaactcttgttgtcattttggataacagaaataatagataattattatggcaatttaaaaaatttaagcaaatataacaaagaaagccaggaccaaccattcttaacattttgatgcattttcttttagttttttgaatatccatgatatgaatcaacattgacaaagtctgatgagaaatttgagtaaattcaattaagtatgtattgtagttcatggttgagtgctggtttatgtttatagtaggcagtctgagttagcagataaaacaagtgattaagaatcaaaccacctatttgtcagcttggtacagatacttcacacaatcctactatctgcctacaatctgttttctaaccctttatcagaggtagagttcaggttccagctctgccacttcttgactggggaagtcactgagccattttcacaacaacaggaagactacaataattaccacaaagttttctggggtcaagtaaaatatatgatctatacctatatacctatgtaatctataaaacagacacagtcatttaacttgaaggagacaaaattatgtttataaacatgtttctatacccaagttttgaactaagtcagatacaagtctgacttagtttaaaattctgattctaacaatttactagctgtgtaaccttgggcaactgctaaacttcctttctgaggaaggcagtttccttgtttatgaatggagcaataaagcctatatcatgaggtaaagcacccagtatggtacctggcatacagtagacatgcaataaatctggacccatagactcaagtgacttgaggctatgcaggtgacacactggtcagagcacaggtagagaaacatgtaaaattcaagttactgtaatcatgtagtaggtaacatgtttagttcaggctgctaaacaataaaacaagggcgttctcacaagaatgagccctttatttttaataatttaagaaaagctagatgttaatcaatctggaatgttggagaggggattcctgtttttggttttaggatgaatcaactacggtatacagcagcatattgaacactgacttatgtcaggaatgtgctaaatgatgtagtcataaacaaaacaaaaatgtccttagagatcttgcattccaacaggtgtgactgtaaatcctgttggctttcccttcaatgtatattcagaatctcaacacttctcactacctctattgctccctctctgggccaggccaggatgatctctgcctgggtgattgaaatcagtctttataatggtcttcctgcttccactctattttcaatataacaattaagagtcatccctttaaaatgttaagtcagattatgtttctcttgcggtaaaaattccccaatggatctccacctcacttaataaaactcagtcttttttcatgtcccacagcttgcctcttccctgctaactctctgatctcattcattagcagcttgccctcttttcgatattccttgaaccaccacagagtcttctgcctcaggaactttgtactcgctgttccctttgcctataatggtcttttcagacatctgtatggcctgaccctttacctcgttcaggtatttgctcaagtatcacttttctggtgaggacttaaattcacaagctcccattgttgtttgtgtatgtgtgtatatatgcattatacccacacacctgtactagattacaatgtttagaaaaatactgagcactatctatttattccagaggttccttcaatcccacttcaggtttcggtaagcctttggaagacaaccaataatcatttgtagttttaacagggggtacttacttttattctagagcacttttctctcaggctttccgtaaggtgctgttgtccatcacttagtaaccttttttcaggttttacttggtggttctgtcggtcctgctttggtaaaaagaaaataaacagggcttttgtcatgactatattcacatataatgtctaatcgcacacttctaaattacatgacatttcaataatggaattaaatattatacttgtcactcaaaagcaatgttaaaatgatcagaaaatgaataatagtatcagtaagttttatagggagtgaccttaactcattggtaaaaaagtagaaaaatcatctaatttttggagacaggatttgtttttcatagctacaaattaggttttagggccaggcatggtagctcacgcctgtaatcctagcactttaggagatcgaggcaggaggatcacttgagctcaggagctcaaaaccagcctcagcaacatagtgagaccctgtctctataaaaataaataaataaataaataaacaaccaggaaaacaaataaattagattttaatttctgattcctactcttccaaatctctgcattattcacttgtagttttaacagtggcacttgcttttatcctaatgcactttattggcgccaaccaaatatactggcaaaaccacctgtactgtctatggtgtttcaaaccctagtcatatattcttcccagcaccttggaaaagttcatatcctgtgtacattttgcatttctgattaaaaagtataaagtgaaacaaaaacattttctcccacttatcttgttcactacagtacctagaagaatatttgatgaatgaattaaatctctctataaatttagttcaggcccacataaagaaatatgagaataaaaaagatttttacagattttaataaacttgtctgaactctgttactttcaaaaagaggatttaattagatattttaagatatatgattctgaatatctataaatagtcataccagaggaacttaatttttatatttatcttcccttttttccttttaacttcaccaataagagcccaactctagaactccagcatgtataggtagagaaatgggaatatttgctctcttacaaatctaatccttcaaatatttctccatttagaataatgctatctcttgattaaaaaaaactttaaaatgttatattaagggaaatagactgctttaacacagtttataaaaataaagaattaaatgttattttctgaaaatatttttgcttcttttaaaactgttttctattgtgtaaaaattagagtaaccatttcccactgtcctttactgttcataggaatttccagagaaagaaataaaaacattgtaattcttttcaaaaaagcttaattcttattaatagttactacacaaaggaagactctgaactcactctagctatcatttcccttaaggttgctatgaattggtccctttccattttgagagattcttttatcctccttagctcatctctttctttagctacaattcttatttcttcaaggctttcatgaagtttcttagtcaactggaagttatccattctcacactttgcatagataagttttgggcctcaaattgcttcttcaactgttccatttcattaatttttttatgactcatattgacatcttctttcactctaagcagttgaagttcttttttctgaagttcttggatcttgagataattgtaaaacaagttagaatgtaagcagtttcttcaaggaaggcaaatagtgtctacttgtgttctatatgcacatatctatctacatatctgtatctatatctttttaattccacaaataattttgggcacagttacttccaaaagaagaacaaaacaacacatacctttttctgtaattcatcttttgatttatctaaatccttttgaatgtctgaaatttgaattgtcttttctgaaattttttctctaagtttatcaacagtttctttgtgttcttttgatagcatacgagcagtttttagttcctgttgtatttccagatcctttatggttagaagaaatcaagaaatgtaatgatataaaggcacgttacctttacttaatgattgagtttaaacaaaatcttaaaaattatacactcacagttaaaaacaaccattatacaacctcctaaattagaagagtaaagtaaaattttctgctggtagcctcacccatagccttctcctttcataccacttggacatctttctaaatcaatatcacaaaaagaataccccattcttatgcttagttttccattatacagatagtgccttattattggtggacacttagattatttctaggttttagtcaccagacacaacgctgcagtgaacactgtatttttgcccaaatatgtgaatataatggtagggtaaagagagaacacaactcactctagctttggtttcttgcaggctttccttgagttggtctctctccagtttgagtgtctcctctactcttcttagattatctctttctttcattacagatttcatttcttcaaggttttcatgaagtttctgagccaaatttaaattctctatttctaatttactcagagttaagctttggtcttttatttgtttctttagttgctccatttcagacacttttttctgtgtctcattgacatctttttttaacgtaataagttgatgttcatttgccttaagttcttgaatcttaagataatcataaaataatatgttaggtggctttttagggacagataaataatagtttctaaattgattaagacaactgtctacccatgttactctcactgatatcctgcacaattccacacagaattttactttcttttgaggtataatatatataaagcatgctcatcttcaatgtataacttaattattcttgacacaggtgtaaatctatgaaactacaacccagattaaaacagagaatatttctagcacttcataaagtttctgtgtgctccttcctagagacagccactattctgacctttatcatcctggttcagttttgcctgcttttgaacctatatatcacaatgtatgtatccattttcctgctgatagacatttgagttttcagttttttgttattttgaataaggctgctataaacattcttgtgtctttttatagaagtatgtacgtactcttttctcttatgtacatacccaagaagtggaaatgttgggcctcaggcaggctacatccagcattagtaaatactgccaaggtgttttccagtgtggttgaaccattttatatccccaacaattttaggcacaaacaaattagatatccaatcaaacaatccccccataaaaataccttttcttgtaatttagcatttgaattttctaaatctttttgcatatttgatagtttatctgtcttctcagaaacaattcctctgagtttgtcaatagtttcctgctgctctttcagatgcatgtgagcaattcttagttcctcttgtattttcagatcctttaccattagagaaattttaaaaacagtgacatatcttaatattagtttttaaaaaataaagtgatatattttcttagtaaaaataataacactgttactctatatctttgctgttgtttttaaggtacaggctttctcttccctgtcctcctctcttcacactctacttctgctttccagaggcaaacacattacacatatattactttttttaagtgttgcatagtatttcgatatattgttcatatttactgtttccttctgaggaacatttagattgtttcagatttttaattaaaatcactacaataaataacctgtggcatatgtatacgttgtgtttgtatatacacacacactcctttaacagtatatatgtaggctaaagtccgtaaggaaaatgataattgcagacttgaacttttcaagaacagtaccaaattatctgcttaaaaggctgtatcatttcattcttgccaacagtagtacttggttcaaagaagggttcattgctgtaagaacacaatacattgaattgccagggagaggaatgagcttactttagcttctatttctctaaggccttccctaagttggtcttgctccattttaaagatttcctctactcctcttaggccatcattttccttagtaacaaatcttacatcctgaaggttttcatgaagcttctgagtcaatcttaatttctgcgtttctacactttccagagttacattccaggcctctaactgcttctttaactgacctgtttgatacatagtttccctaagatcattttttactttaagaagttgaggctgggcctggcggctcatgcctgtaatcccagcactttgggaggccgaggcgggtggatcatgaggtcaggagatcgagaccaccctggtcaacacggtgaaacctcctctctactaaaaatacaaaaattagctgggtgtgatgacatgcatctgtaatcctagttacttgggagacttgaggcaggagaatcgcttgaacccgggaggcagacattgcagtgagccgagatcatgccgttgcactccaggcgacagagcgagactctgtctcaaaaaaaaaaaaaaaaaaaaaaaagaagttgatgttctttctcctgaagttcttggatcttgagataatcatacaataagttaggattatcagtagatataaaaagatcaatgatagtttctaaattgagtaggcaagtaagtcttcacttgccttcaattttagggtaattcatatcttgtttcattacacaaaaagtttgattcaaactctcagtaactgagataacttaaaaataaaatacctgtgcttttaaggcatcatttgagtgttctaagtccttttgcatatttgatatttcatttgttttctctgaaacaatccctcttagtttatcaatagtttcttggtgctccttcagatgcatgtgaacaatttttagctcctcttgtttttctaggtcctttatcaatagaaaaataaaaataatacattgagagtagtaccatccacatgctatagaaaggtatagggcaggaggtaaaaatcttccaccctcttctgaggcctcctagttctcaccctctaagctacttttagatgtcaatacattctagatacactattcctgaacttaccctgttccctaacaggacacttcacccttcaaatcagcactatagctctaccacattttttatttgtggcatagaattccatgacgtgaatgtgctgcacttatttaaccagtcccttaccaatggatggttagaattttccctgtttttgtttgtgttatttcattattgcaacttgttgcaaagaatatcctacaaatatctttatacagttgtgcaaatgtgtggaggatagttacaactggacttgtggatcaacgaataaacctttggaaaaatttggaaggtatttccaaatataccctcaccaactttcctcaatattggaccaattttatcttattttattattttttattttattttactttttgagatggagtcttgctctgtcgcccaggctggagtgcagtggtgcgatcttggctcactgcaacctccgcctcctgggttcacgccattctcctgtctcagcctcccaagtagctgggactacaggcgcccaccaccacgcctgcctaattttttatgtttttagtagagatggcgtttcaccatgttagccaggatggtcttgatctcctgacctcgtgatctgcccgccctggcctcccaaagtgctgggattaccggctcgagccaccgcgcccggcctggaccaattttatactcccaccaaccctatggcagatttttctcttaggactcaatgtcatagttactagaggtgtagagagatggtaactcactctagttatagtttctctaaggttttccttgagctggtctctctctactttgagagtctcctccacactcctaaggtcatctctttcttttgttacagatctcatttcttcaaggttttcatgtagtatctgagtcaaccttatattctccgtttctatgttttccaggtttaacttctgggtctcaaattgctccttcaagtgttctatttcacacattttctcctgagtctcattgacagctgtcatcttaagaaactgatattctttttcttgagattctttcatctgagaaaattataaagtaagttacaacataggcagaatttttttaggaaaaggaagaactgttcctaaaataaggcaatcatttttacattgtaatctaatgtatgtagtactttctttcataagggatatgagtaacaataattagatgtcattttccaatttaacaagtcccactttttcctgtaattcaccatcagaatttcctaaatcccaatgaatatttgctacttgagctgtcttctctgaaatattctgtctactaacagtttactggtactcagttgaatataagcagtttttgattcctcttttatttccggtccctttatgattagaggaaaattaataaaacttaacatgaacaccgtcattatcaccttaacactatttctgtatccaaaaaaaaaaaaaataagatgggaacttactttagctacaatttctttagtgttttctttcagttggtctctctctatctgaagggcctcctgtactcttttcatttcctctttttccttaatcataatttgtatttcttcttgactttcttgaagtctgttggtcaactcgagcatcttactttctatactttgtagtgctgaatccttggctttgcgatgctccttgaattgtttcagttcattcactttttcctgaacctcactaatttgttttatattaaattgttcctctttctcataaatctcttggatcttaaacataattataaaataagttaatagtcataaaaatatgtaaacacacacacacacatacacaacttaagaggaaaaggttgcttcccaaaacaattaagcatgccaaatagtagtcttcataattcagttagctactccaaacccacccatttcctcccactgtttcttcatccccaatttaccttgttctgtaatttatcattgattgcttctaactgcttttgaatggttgatatttcagtttccttctctgaaagattcactcttaactcattaatagtttcctcttgttctttcaggcaacaatgagcaactttaagttcctcttcagtttccaggtgctttattattagaggaaattccaataaatttatagaaacattataactattttgttgtaattaactcccctttccaaatatttagggtttataataatatttggttacaaaatattttttaaaaacatggtgaaagatgaaacctactttagctacaatttcttttatgttttctttgagctggtcactttcagattgaagaacttcttgcagcctctgtaggtcatctttctccttagctacagatttcatttcatcatgactttcttgaagtcttttggacaatccgagcatttctatttctatccttagtagtgctgaatctttgggtttgaattgctccatctcactcacgattttggtagtttcattgtctttttctttcatatttaaggactgttcttgtttgctttgagactcctggatcttaagagaatcataaaacagtacagttgatatccagagatattgtgttttaggggaaaataaatcaggatgctttctaaaacaattaaggcaggattcagtgcctcatttacagagcaatctctccattctcccactcttccattattcaggcatttaatgctttttaaaaattgaggtctcactgtgttgtcagcatcttattcgaggctggagacaaaatgatgagacttacaggatctctctctttttgagacttatacttcaaggacaaagatagatatgatgttgaatcttaccaaatagagatgctggcttctcctacggcccaagtgtcaaatataatctattgtgaatgataggaagggattcctagaggagaaagctttaactgagatctgaaggataagagcattagttaggcaaaaaggagtatggaggtactgcaggtagagagacctgagaatctgaaagccatgagctgcggaagagagttgctggagaacaaagaataggaagaagaatgaattgaaataagaccggcaagatctgcacctagggcctcataggccacataaaggatcctggtctttatttaaaaagtagcaataagatattaaaagaatgtaagaaaggataacttaggcttagtatagaaactggattagagaagtctaagaatgagtgtgggaagaccagttaggagactactgcagatagccagggaaagaaatgatgttgacttggattagggtggtggcagtgtggagagaaaagcaggatgacttttaaaatacacactcaaatcaataagatttggtgactggattacagaataagcagagaaggaggcatattagtagggatagctcccagatttctgactaaaacaatgagaaagcacagtagtgctttatgaaacattaaaggaacaggtttaaaaaagaaaataaaacaatctcatatttggtttcaccctttcttgtaatttagaattattttttctaaattattttttgaatatttaagaaaacagttcttttctctgaaacatcttctctctgtttcaataccttcttggtattcaagagcaatttttaattgttctgtttctagtcatttcatgattaagagacattaaaaaaactggtaacataattataatacaaacattataactataacacaaacacaagccttgattcttataagacacttgttaaaatgggaggaaaatacgaaacttactttagccaaagtttctctaatatgttctttcagctggtcatgtttaacttcaagggcttcttttatcgttttaaggttgtctctttccttggttagagattttatctcttcctgactttcttgaaatttttcattcaacctgagcctttccatttctattcttgccagtgttgttgagtccttggttgtggactgttctgttaataactccagttcattcattgtttcctgagtctcactgacttctttcacattaggcagtaactcttgttcctcatgaagcactgggatcttaggacattcataaaataccaaggttactatcaggagattatgatcataatttttttttttttgagacggcatctcactctgttgcccaggtgggagtgcagtggcgcaatctcagttcactgcaacttctgcctcctgggttcaagagattctcctgtctcagtctcctgagtagctgggattacaggtgtgtgctaccatgcctggctaatttttgtatttttagtagagacggggtttcaccatgttggccaggctggtctcaaactcctgacctcaggtgatctgcctgccttggcctcccaaagtgctgggattacaggtgtgagccaccgcatcccactggccattatcataaatttttaaagggaaaagatcaggatacttttcacagcaaggaaagtcatcttgaaccctcaggcctaccttggatcacaaactgctcattattcattttccctcaattcctgctaaagctattcatgacttttctgggtcacattctgtcatacttttctttctttgtagcttagacccaaagtgaaccaattatactttgctagcagtctgtttcatacttatttctccactagtttccaagctataagagaaaaaccatagctgagcaaactatatcccaataaatgtatgatctccattttcagatgggctccaatgctatgtctcaatttttctatgtgtatagattgatttctctttccatgataaattagtggtaccatgtaattttgcgtatttctgcatttaccatattggaattaagggattttctttctagtttataatggggggaaagaacaatgtcttatttatatctacagtctcaatgtctggcatggagtaggcttttaatacaggttggcccagtaatcccaatgtttcactttctccatagcatttaccactatttaatgttttcttgttcatttgattgcttatttatcagctactttctttcactacaaatggatcagagggattttaggggttttgtccaccttgttctcattgcatttctataacctaggagtgtgcctgccacattaaacactcgacaaatacttacccagtcaattaatgaaccacatcctagctacttcttactgcttatctttccttcaaaggagaaaggaaggaagaagtgacaaaggatgaaaggaataaaagacatacctcttcttgtaatttggtatgggatttttctaagtcctgagtatttattatttgagctgtcttctcagatacgcttcttcttagttcatcaatagtttcttggtgttcttttaggtgaatatgagcaatttttagttcttctttggtttgtaggcccttggcgagtgaaatttaaagaatattgtaatattcttccaacattgctcccctctttccaagtggctcagattttaaaagaaacacttaatagatgaaggaaaagggtataacttactgtagcttcaatttctcttatatatcctctaaggtggtctctctctgtttcaaatgacttctgtaattcctttagaacttttctttctttggttatagatttcacttcctcataattttcattaagtttctgagccaactcaagcctctctgtttccatatgttccaatgtcaattctttgttctttaattcattctttaaattctctatttcattaatctttttctgcatctcactcatctcttcttgtacattaagaagttgttgctgtttttcttggagttgctggctcttaaaatgcacaatttttataattaccattttacttatattctcaaaattcttacacaaaatcattaacagccttgcctcctatcagcatataaataggtaagtagcattaaaagtaaatgaaactcacaggcataaatgtctgcagtggtttgaatattgtcccacccaaaattcatgtctcccaggaacctcagaatgtgaacttatttggaaatagagtctttgcagatgtaattggattaggattgagacgtgatcctactggagtaggtcttcattccaatgagtgtatttataagagacataaaagcacatagagaggcacagagaaggaggtcatgtgaagcagttacaagccaaggaatgcgaagggtagctgggagacactggaagctaggaagaagtaaggaatgattcttccttagagccttcagagggaatatggtattgctgacacttaaatttggacttctaggactcagaactgtgacagaatatgtctctattgtaagccatcaagtttacagcaatttgctatggcagccctaggaaactgatacaggctgattaaggagataaactgattaaggagataaggggaagatgagataaagtaaaaaagcaaagagactaattaaatatacaaatacagctaccaaataactataattcctcatcctcttaaaaaacttttggagaatttattttcacttccaataagatgcttatgggtggctcccccaaatactgagacattaaccttcacaggctattgattttaccttttttataggagtatgaaatagacataaggttttagtaaactcaattaggtgagatagtgaaagggatcagaattaaaagaaaacacatattaagaaaaaaacaggctgggcatgatggctcacacctgtaatcctagcactttggaaggctgaggcaggaagactgcttgagcccaggagtttgagaccagcctgggcaacacagtgagacctcgtttctaccaaaaatacaacaattagctgggtgttgtggcacagctaatttagtctcagctactcgggaggctgaagtgggaggacagcctgaacccagggggggttgaggctacagtgagctgtgatcatgccactgcactccagcctgggtgacagagtgagaccctgtctcaaaaaaaaaaggaggaaagaaaaaagaaaaaatattccacagaataataacagaaccgtactatattatctattatgcaagtggcactgcccttagcttatatagaaagatctctatgggtgcattttagaatctcttgggaactacagctgttacaggggtcttagctcttacacaaatatcccaataacacctaacttctatataagaaatgattcaggaaactgcaaacatctaagagatggtaatagtgataaatcttacatttcaaaatgactaatgcatctctgcaaggaaagaatctttgttttgttgactaatatatctcaagtgcccaaaacagtgcgtggcccatgacagtgctcaataaatatttgatgaatgaatacatcatatgatttgtttaaatgatacaaagccctctctcacctaaagactctggaataatataatcctcataaggtatgttagtttagatctcagtgtaagttaaaattgtccaaaatactagcattgaaatatgttcatttgggaggtatgtgctatttctggatttaggtctacagaaataaaaattaccaaaaaaaaagtttagttagaaaaaatggccagggaaataactttaaaaattcaccttttcctttagtttttcttcaacttctgccagtctgtcacaggtcctagaaagctctccttctttctttatggcatggttcttttcttgtgcaactatctcttgttgctttttaagttcatccccaagaagtcttaattcttcctggttttcaatggtctagaaagaaaaaaaaagttgagattaaagtaaatattagctaacatttatgaaatcaggtaaaacatcagcatttctctcagtctgcaaatgaagaaatcagggaaaactatataggaaaagacaaatttcaaaaaagaaagtccttattttaataatataagatgccaagaatctgctttttatactgtttctttactgctcaatttacattcctaccatgagaattagaattgcatttaacattctatcatgagagcttagcttatttctacctttaagtcaaaagagactttttctgagctatcactgagtaataatgagactacagctatagttttttcaaacactgggatggctttggttttagcacagatcactgccagcgagctcaaaatggcagccaccctctgctagcatgacttgggctgatcctggttattaggctcacacagtgacattctcacgtatcaagaccacaaaaacataacaagccagagactgagaagaaaataccattgtttgtttgtgtgcttatttacattctgctcttttgatgaaggagacaatccccaaaacttataaaattaaaacaatacaaatggtcgcattctactatgatccacagtgaacttctccaaatatttatttaaacttatacacattgtatcacccctaaacatagaaaacctaagtgtgaaaatattggcagacatcaacaacaaacaattaaaaataaaatttaaaaattatgacagcaaaaaaaaagagaaacatttaggaacaaatttaataaaatattaaaagacctatacactgaaaatctacaacatacctctttgagaacagacaaattacagaagaagatatacaatggtctagaagcataagaaaaaatgttcaacatcttagtcattagggaaaggcaaattaaaacaacagtctgcacacccattagaatggctaaaattaaaagcaccaataaatatgaagtgttggtgaagaaggatgtttgagccaccagaattctcttaatttgctaatgggaatgtaaaatgatataattactttggaaatcagtctagcaaattctcatcaagttaaacatattcttccctgtgacacagcaattccatttagatatttaccttaagtaaataaagctatgtaaataaaaagagttgtacgagaatgtttacagcagttttattcaaaatagccaaatactgaacggaacccaaatttccatcaataggaaaaagaataaaaaaattatggcgtattaatacaatgaactattccttggcagtaaaagggagtgtagaaagtcaaacataagagactacatactgtatgattctatttgtataaagctctagaagagacaaatgatttaaggtgaacatatcaggactgataatctggcggggaggaggtgatgagggtctgtgatagaggtgtgaggaaactttctgggggtgatggaaacatcttctatcttgactggggtgaagaggaaatgggtagagacatttgttaaaagtcgtcagaccatacacttccaccagatacatttattgtatataaattatacctcaataaagttgataaaaatctgaaacaaatgaagacaaaaaggtaatgccaagtatacagtgctaaatcctaccatttcaatattttcctttaggtcagtcttcaattgttccttttctgctataacactctctaacatttgttggagttcatttttctcctgtattaaagaaaatatcttcctttgttgctcaattatctcattatccttaacatctgcagttagtgtttgggtatttttagcttccaaatcctgttttttatctatgccaaccatctaaaacataaacacattacagaagaatttcttaagtagttaacaacaactttaaaaaataataaaaatagccaacacatctattatgtgccaggtactattctcatatcttaacacatttaatcttgacagtaactttatgaggtaggtattaccataatcttcatttgacagatgaggaaactgaactggagagaggtaaagtcacttgcccaaggtcactcagaggtttagctaggttttgaatccaagtgatctggctccaaagtttgtgctcttacgtctgttcactaatcagaacaatatggacaactacaaatattaataattgtcttcacgtatgataggttaacatgattctgcatgtttacttatttcaatgacattaatacattaattaaaggatatctgcctttagtttgtacacatcttccataaatattttccaagtttcattctagtagtagtttgtttatttactactaaacgagtaagcaatcttgaactctatcactttatctatttcctcctaaaagctgggaatcattccctgtctcccactccctgcaaatctttattttcagaggcagtcctacttacaaaaggctggagttttattatatgtagggggataaataattttgataaagatctatttcataagggtgaaattcatcttttcttaatatatgtatattttatatactgcttaagaaaaatgttatataaattcatttattcataaataagtcacgaccaaatgtaacctaatacgtgaacttattggtaaagggagacagagactgaaattactattgctggtacaaatttagggtattattgtatgacattacactagttcagcaaacagctccatattgcctacacaggtatttaaaagtttttataataatctataatcacattagaaaacaatagaaaaataaaggataaaaatcatccactgtcaccaacttcacacaacaaactattagaattctggtaaatttacttctggagttttttccattaaaggttttttttttgtttttttgttttttaaacatagctattataatgaatttatatgtgtgattctttttagtttttatcttttccacttagatcatatgtattttcacatgttgttatgtaacctacaaataatttttagtagctgcttgattctctagagtagatataaactgtactttatttagcaacccccttattgttggcaatatgcatgagcttctagaagataacagtgatcacagagctaactacatgagaaattaaggtagggaacacgtagtcttttgggactagtctgttagatattataattcagaatctcatatctttcaaatacaaagcagattgagacaaaattttctgtaatgatagccaaggtttatttcaaatctgaactcagcctagaaggtacttcaactaccacagttatgaataaaatctaatagatctaattattaaataaaaaattattagaacctgtgaaaaaggaaaaaaattgtcctttatataagaataagcttactaatcataaaatatttttgttgagatacattaaaaatactgcatttccagaaacagacacatcaagtaggactaaaaatgagcattccaaggagattcatgatagacctgctagtgcagctctctggtgcctagatgaacaggggagcacctggaaatccccatttccactcttttattcccatggcagattccagcatgagcatgatacaagaccaaattgatctcagccttccatcccagactttaggatccctggtgaacagaatggcctcagaaaagccccagctacatccttttatcaacatggataaatgactccagcatatacttggtaacataggatcttagctgttcccagtgagtataactctactcttcccttcatcttctattgtctctataactgcattttggatttgtttaaaacagttattgattgccatatattattgtcaaaagtctactaaaaaaactttcccatcataaaagtggaagttattatttctttctttttttttagacagggtctcactctgtcgcccaagctggagtgctgcagcatgatctgggctcactgcagcctcaaccttcctgggctcaggtgatcctcctacctcagcctcctgagtggctgagactacaggtgcattgctaccatgcctggctaatttttgtatttttttgtagagacggggtttcaccatgttgcccaggccggtcttgaactcctggactcaagcaatctgcccaccttggcctctgaaagtactaggattacaggcataagccattgtgttgagggtaaatttcaaattgaggtcaaatgcctttggcctatggttattccaaattataaataagctgagaacataagatacagaaaaagtgagagagaagaactaaagcataaggagatggaaataaaaaaaaagttccattttccaaggcagtattttgccccggagtaaatgggggaaaatgcagctcattttatagaagtaatatataaatgtacagatatttatttatatcaattggatcttactgaattactttgaaatgtgtatttgcttttatttaataatgtattctgttaaaaatgcatgactgtacaaacatcagtagcatttctgtacactaacaatgaacgatccaaagaagaaattaagacaattttatgtataatagcatcaaaaaagaacaaaatactaagaataaacttaaccaaggaggtgaaagacatctgctgaaaactgtaaatgttgctgagaagaaattaaagaagacacaaatggtaagacatcccatgttcatggattagaagacaatatttttaagacatcaatactaccgaacaatctaccatttaatgtaatccctatcaaaatcccaatggtgtcttttgcagaattagaaaaatctatcctaagattaatatagaaccttaaagggccccaaatagggaaacgaatcttgaaaaagaagaacgaagttggaggtcttgtacttcctgatttcaaaacttataaagctacagtaatcaaaacaatgtggtgctagcataaagacagacatataaaccattggaacagaatagaaagaccagaaattaatgcttgtgtatatggtcacagtatcttcaacaaggatgccaagactactcaatggggacaggatgatcttttcaaaaaatggtgttgggaaaacaatagccacacacaaaagaacgaagttgtaccctgaccttacactatatatacaaataaatgcaaaatggattacaggcctaaacgtaagagtgaaaattacaaaactcttagaagaaaacataggggaacagattcatgataagggtcttggcaatgatttcttggatatgacaccaaaacacaggcaacaagagtaaaaataaataaacttgactacattgaaattaaaaacttctgtgtatcaaaggatacaatcaacagagtaaaaagacagccgatggaatgggaggaaatttttgcaatattgcatataactgataaaggggtaatattcagaagtataaagaactcctacaactcaatgacaaaaatcaaacaacccagtataaaaatgggaaaagacttaaatagacatttctgcaaggaagataaacaaatggccaaaaagcacacgaagattcaacatcactaatcattaggaaaatgcaactcaaaaccacgatgagatactgcctcacatccattaggatggctactatcaaaaaaaaaaaaaaaaaaaaacagaaaatagtgtgttggcaaaggtgcatataaaccagaacacttctgtcctgttggtgggaagtaaaatggtgcagctgttatggaaaacattatggtgctttctcaaaaaattaaaaatagaattaccatataacctagcaattccacttctggatatatatatccaaaataactgaaagcagggttttgaagagatatttgttcactcacattcataggagctttattcacaacagccaataatgggtagaagcaacgcaagtgtccatgatggatgcatagataagcaaactgtggcatatacatataatggaaatttactcataaaaaggaaggaaattctaacacatgctacaacatggatgaagacattatgcaaaatgagacaggtcagtcacaaaagataaatactgcatgattccacttatatgaggtactcagagtagtcaaattcataaagacagaaaaataaatggtggtagccagggtctgtgggaaggaaaactggggagctgttgctcaatgggtatagttttggttttgcaagatgaaaagaattctggaaattggttgtatcacaatgtgaatgaattttacactagtgaagtatatacttaaaatggttaaggtggtaaattttatgttatgtgtattttactaccaatttaaaaaatatatactactatatactattccaagctatatatttacaaaagattatttcaccagtctcctattgaatattttaaaattctagcagtaaatactctggataaaataatatgaactataataaaaatgagacatgttattacaaaattactgttaccaatatatcttagaggtgttgtgggaaagtagaaaagaatactgttaataaatgaaaccctggtataacgttataaggcaatcccctctgcaatggactgaattttaaactctaagcaagtttagtatagtaaatttgacataaaataagtatcagctatgcaaaatttggactaatacatttttgggccctttccctttctaattgattataaacatattctatcataagttatttcaaaggcattagggataagcttgtaaaattattgttagttattaccattgtgagtaacaaatgaaattgagaatattatgcatttaagtatttgaggttaaagagtatatatacaagcatatgaaaactctgaaaataaacaccctttaccttttgctgaaattcatctttagtttctcctgtattttcctccatatgcaaattcctggaaacttcctcagaaattttcgattttagtgtattaattgtttcttgatgttgtttcagagactcaagagcatttcgtaattgttcttgagtatctatattctttgttagaaaaatataaaaacaatttccattagaatatgaaacaaaattattttgtagctactacataacataatcataaataataaatgatggcctctgcaatgtttttaagagtctccaatttttcaaagtttaatcaatcaaaaccttaccatgttaacagtatcgtgaatatcacttttgagttggtccctctcaatttgcaagctttcttggagttgttttagatcatctttttcttgagttaaagtttttacttcttctaaagtttgctgcagtttctcagtaatcagtgttttctccctttctacagtttgcagcgtagaatctctattttctaattgttccttcagctgttccatctcatttagtctttcttgaacctcacgtgttttctcctgaagttcttgggtcttgtaagaaagctttaaaaaagaaaaagtaaatgtcacacagtaaaagcagagcagtctgaggcatacatatatacagaaaccaaaaccccagaagactaaggagcatttctcaaaatagcatcttgtaccaacctcggtcttcaaagcacccaaactcgaatcaaatttttgggcttctttagagagattaactatttcctgattcattctctcattctcctcaaggaccatcttatacttttgctcaaagtccatatgaagggttttgaaattttggaattcttgatcagtgcttttataattcgactgtgtagttgctaggtcatcttttgttttcccaatttcttcaagtaaaccttgaactctactctccttatgaactacttcagaaaacaatttatctttttctgatgttattatatggagctcttcagatttgtcttgtatctatggaaaagaaataaaatttagggatgttagcaacatatgattcactgaagcaatttttaggaaaaaaagctttctctgcaaaaagagaagttatttacattcagcaaaaatttgactgtggaaaggcaatatagtagtactcttattgtcacttttccctaactcagcttgtttaactctacctttgatgttttattttctaatctctttgtattctagaaagtaaggtctgcatggaaaatagtaaaggcacataatcagattgtctttatttccttacctatcattttaaagtgttttctaactttatcatgtggcaggcatttctcagaatttgacatttttttccctaaaggctttgaatgcctctcaggtttccaaaaacttaatcaatgaataatttaagtaatgtttaatcatttaaaattgttatttaagaagtatcttaagtggtatggtccatgaaaaaaataaaaatagaagtaccacttaagtaatatttaaataattacataatttaaataacccatatcttgtatattaacagtttaatcactgtgaaagataagggcagagagagatgagaaaaaaagaagagataaaggagggacaaagtaaagacgggcaatacagcgtgtagctacaatcacgggtttaggaggcagatttatgtggctcaattatgagtttgataatgggttattgggactaaaaaactacctatttttgaagagtttataagacgagtaaatgaaataatgtttttgaagttctttagcatgatgtttgccatacagtaagtactcaaatttttgccatttttcttttagacaagtagaaagaaaaactggcaggccatggatttacagaaacattcaccagcctgcaaggtttgcattaacctctaaaactttatcagtgcaacctcttttccctcattactgtcttttattcaacataatgatactactactaccaaaaaaaatggtaaagactaagggtgggccgtaatactgtataaatgcaacatttgaggactacagaaatggctgctacatggattatattactaagtattctgttaaatacaccttgaaaaaatatattttttaatctagtagcataagaacaaattagaagatgaactatattcatttctatttctaactagtcaaaacgtttacagtatctctcttgtctgctagtttaaaataaactataccaaaatatttaaggcactattatcgcaaaggtttttatttcaaaataagggataagtgcttataaatgtgtttacctctttcctcagcctttctacttcagaaggtaaagatttcaattctgaaagcaaaatgacttcttcccgcaaagcttcattttcttcaacttctttatttagttctttctgaagatcagtaatctttccttccaattccaaattacagagcaaatctagaaagttttggtaaattgtataaagatccaatgttgccaaacaggtaatttaatttttaattgtccttgaatcacctttttcaggatcaggtaaagtttatttgaaaaataatcccttatgatttgaaacccatggaaatctttataaatattaataccaaatgaaactaaaacgtaatattgagtttttaaaaagtcagagtataatgaatttttaatcattgaaatatgcttgtcaaattgtttaggtacatttctagaagaagtcagatttgaaaaaagatgtttaaaattacaaaataccttttggaactttgccatctataagggaggtgagttttgttatctcattaaaagcagattgtaattctttctccagatcaacttgcattttcttttttgcctccaactggctttgatataactgaatatcattttccatttgcttgtatgtagttgcaagttctttctattgagaaaaacattgcaaatgcacaaaaatacactgatcattacaactactttattataaatattacaaaaaatacttaccattttctccttcagctccagattttcacttctaagaaaggctgattctctcttggcatcaagggctacagtttcagcatcaaacagagtctgcttcatttgttttgggtcttcaatgctttcctagacagatgacaaaaggggttcactgaaatctaattttcacagagttggaaaattcttaagagaacatgtatataaatgttaactctagctaatcaaaaagcgtacaaatatgctagttaccaaatatataaaaagaaataatgttttcctaataaaaataatttttaaaaattctggtcatatttttcaaattatataagcaatatatcaaattatataagcaatgtatcataatttagatctgttttgtttaaaggttaaaacaactgttgttcggcaaggctgatgaagttttctatgtatttttattttgagttattctcttcagcacatgataggtaagtggctaacagttaaattaaagatattaacccacaaattgaaaaggaaaaagacaaatgatctaatagaaaaatagagaaatgatatgaacaagaaacttacagatgagaaaatgcaaatgaaaaatacatgaaaaaaatctacaacctcatttctaaagagaagtggcattttaatatgactttagcttatatgaaatcaatgatatgtccttggaaaaaaattaataaattaatacatgaatgaataaggaaaaagaaatagtaatttttaaaaagtgggcagttctgcttgccacgctatgaacagacactccagaatacataaaagtgccttcctatccagggcctcagaataggatgatatgaaatggtatgaacccctttgaaaagaatcatttgtcacaaataaaaggcaacaaaagaatagaaggtaacaaaaactaaaaaactcaactgaaaacagaagaacagaaactagtcttttaaaagttccagctagaaactgttatcataaaaaaaaaagtattaaaaactggaaccaaacatatataagtaatcaggtatactgaaagcaaactgaagcgattaaatgacatcatcatcagattcaatgttagttaatgccaagatcttatatcaactaaaatcatctagagctataaaattgtgaaaaaatatcccagtttaatatttaagatcttgactatatactactgcatgcatttgtataaaactactgaaaaaaattcggaattttaaaattttactgatttttttttttttttggagacagagtcttgctctgttgcccaggctggagtgcaatggcatgatctcggctcatggcagcctcaacctcccaggctcaagcaatcctgccacctcagttacccaagtagctggcagtacctgccaggcttatttttgtatattttgtacagaccaggtctcactatgttgcccaggctggtcttgaactcctgggctcaagtgatctcccacttcggcctcccaaagtactggcatcacagggatgagccactgtgccctggcctaaaacttactgatttttaatgggagcctgtccttaacttccttatatttactcaaaggatgacatgatcaactttccacaaatgtgactttatctctaaaatggcaaatatactaacagtccctatctcatagggttattgacagatttaatgaaatatatataaatttattacaacaatacacagcacaaagtaggtccagtataagcatttgctaagatgatggtatgctatatatatttatgtgattacacaacaaaatacgcctgatttttaccaatgagtatgacaagtccatttttatattttctagcttttgagagtctatgtattcctgtagcttcttaatctggtcttccttttctctaagcagctctacttttgaactgagttcattctaaaagaatcaaaggagagagtaacaatttagaatctgatttgaagtctaagggattaaaacagaacttatatatattagtttaaattcatagtaaaattcaaagtcactaatattttaaaaacataattcccttatttctgacatcatgttcagttacatatgttgcatgttttatagttctaattgcttatcaatagaaataccaacatgaatgctcacctcaagatcttgattatatacttctgcatgcttaactaaattctttaagttcgaaatttcatgaattagttgcatctgtaagagcatgtgaacaggtaacagagcaaaccaatagttaataaagcaaagcaaaaaaaaaaaaaaaaagaaaaagaaaaaaaagggcactggttcactgcttcagaatcacccaacagttagaaaggactgagatcaattgttcaagctatcgcaacaaagcacctcattatttaaaaatactagaaatatcacccaaaacatatcaaacaaataaaaaaaaacccctcagcatgaccccaccaagtagctatatcatctgttaataaagctacaataatgtcaatagcaaattagtatgcactacttggaggagagatttaaaaagtggtaatcaaaccttgaaaaatacacgtttagtagatttttgttttcagtcagttaagtacagaaatgtattaattcttataaagttttttcttcccataaagtatccatcagctctacattagtgtactttttaataagttctgatttggaatctaggtttggattagggttgtttcatgcagtgcctttacaatattattacttttcaccagtgctacacaggtatggaatgatcaactatgaccttgatttattccagaggaaatattgcactccattatattgttcaaccatgtaaaagtataaaggtagaagtatttctattgaggtgtcctttctaccaaaatatctgtagcattaaatatctgagtaccaaaaagtttgttgaaaacaagtaaaccacacataaccaagataaacattttcccttagaattatttaatcttcataatcagatgagcacttacagagtaaaagcaaattctaatagtatgtaaggggcttgaaaatagtatcttatttaaatattttctggatgtttaactgagtcctgactagttttaaatttcagactagtgcaagtgttgacattactattttaggtcagtgctatccaagagaaacataatgtcagacacatatgtaatttaaaatttcctagtaggcacattaaacctaaaaagaaaaaggcagaattaactttgagaacatattttattcaacctaatatatcaaaaatatttcttccaaaatgtttcttcaggtaatctatccaacatgtttctttaggtaatcaatataaaaaaaatgaacaattttacattcttttttatatactatgtcaattcagtctggtcccatttcaagtgcttaattgccacatatggttagtggctaccccactgtagaacacagtcttagacatttgtactgcttttaatttaaattggctccttctttcaccttttcttccttatttttaacttctgtgaaagaaaatcacatttaccaataagaaagaatcaaaaatcaatcttaacttttaaaaatacttagaagagatcgggtgcattcagggtagtatggccatagataatgaaaacatttaaagaatactaatttagaaaagaaaattttcctacttcttatttgaaatagcactttatcttagtactggttcttatgcatagaaaataattagcttttataaaaataaaagtgtaatctcccaatgacatgtttaagatgcagagcatgaagtgaaagtgtgtgaaaaggaaaaatgatttaaacatatgatctgatctacagttaatccattgctaccatttaaattgcagatttaaatggtaattgtcattaggtgaaatgaaatatttaacttacatctccaagtagtaaaaattataaaattaaatacaccaagttaaaataggtagacggtaaagatttttctcattcctcgagtatggtgatacttgacattttccattctccctctaaaacatactatttaagcatctcatgttactatattcccactagaaaattatctacaacttgggtgatttttgacaaaagctttaggaaaaccagggaaatggctccatgtcctaaggccaatttgacttttattcccttttagctaaacctttccccaaaatgtaggttttggaacatattttgctacatacacatagacttatatttttagtttaacatggactagatactgcaaaactggttttgaacaggatgtttttattacataatcttttaagtaaccttaaattttgtgtcgaattaaaagtaaagggcctagagcagtggctcacacctgtaatcctagcactttgggaggccgaggcgagcagatcacttgagcccaggaatgtgagactagcctggccaacatggcaagacccccgtctctataaagaaaaagttttttaattatatgtcttttagattagaaagctgagctttgtgttttaaaaaaaaaaaaaagaaaaaaaagaaaaagaaatttaaaaagaacggagtaggattcttcctcctcaactgtggttaaaatgggagaaaaactgcagtgtgatacatgtcatatattctgtggtatttttgtaatctttctctgtgttgactcaattcaataagcttcaatttttcttattaatatattaatgatgtgagaaaaatattagagaaattattaccacttatcccaaacgttagttttatgtcatgttattatcacatataaaaaacatacaaaaattagatgaaattttaaagtcagaagggaccttggtgagcatctggtctctacttcaagggtggagaaatacaggaagccctgagattcagtgacttgcccaaggccttggcaacaattcataataggattggatctgcggtaagtttataagtggcaaaactgcggcttaaatccaggcaatttcactctagagaccatgttcttaatcatgacactaggccagtcccttccataaaacctagttttattgattaaagtccaatggttttgtcatgcatgacattttgcacttcattaacatgcattttaaaacaagctaaatgaaaccctgtggagaacttatagacttttacctctttgaatatagtacctatgaaataaagcaataattttaatttgtaggtagaatggaaataatagctttggcatagaattcttttttcctttaaaaatgaaaagaggttgagaaactgaacaatgatatcgaggaaaaagggtcatggccttttgggctagccacatagaagtctgaagagtagctgcaaattaattcatcttttaactacataaaacactgggtcttatttttttttgaaggggggatgttcacgaatcactttgcaagtctgataacaactacagattcttgttccagaaaaatgaatatgcattgaaaaattctgcaaaataatttcacagcatctgtggcctctaggttaaggacactttacactaataactccctttaatcttttggacaatttctgagtccctaaagtctgatggtttctggattaagttctcttaacgtgtagcctaatattttatacttagaaaatgagtgatctgtttctataaattccattataactatttagtattagttatactaattttcacataactctcttagatggagaaggaaaaacaaaacgtacaaaattagcttctccagctattctaatgttttaattatttagaaacatactttctaaagaaaaagaaatccattaatatgtagcatccatatataaaatagtcatctagatattaaaattcatactgatctcagtaggaaactgctgtgctctaggtagcatttatatatgctcaataaaatgtaatatacaaactataaggaaacaatttcaagacaaatccatcaagaggtagatacaccaacccttcccatagatgcttttaattcctttttctcttgcataagcaccagggaaagaaacatgatttaactatttttaaaatataaatgaagaaaatatttcttaaattttctaaattgtatatacatatgaaaaatggttagatcttcaacatctcaatcttagaaaaaaaaatctttaagacaatacttctgagtgatgtcaagaagatgacagaataggaggtcacctgctcacatccccccaaaacaacaagaattctgtacctattacagacaagtctttttgtgggagcctttggattcaggtaggaggttgtaaaaccccagtagaactcaagacctggaagtgttgtttttgagagtgcataccaacacccaggtgggagtcctgccaattgtgctcccaggttcatatgcagaaatggtcccattccttgaaggacttagctacagccctgtttggcctagagtctgcaaccaaaactatctgtcaaggggtccaggagaaatcacacactctagggtctcggcagatgggctcttctgcctgtcgacattggtcttggcagtggacccaaaagttagcctataacttggctcctgccctcctcaagctgtagtcctagcttagtactgcttgcacaaggacccagaagggaacatgcccatctgagccaccaggacaggcttgccggcctctgtctcatagcagattccgacggggacatgtactggctccagccctcccctgctgcagcctccctgctctcacccacacagagaactgccaagagatgaacctgtctgagccactgggtcaggcttgcagtcctccatcccacaatagactgaaggggccctgtctcagcttcaatgcctctttgctgcagtcaggaagctatctcgactgtattgggaactgctgggtgaagcacctgccccagccaccaggacaggtttcatgcatctttcccataatagatcctaaagcagtcttgtcttgactgcagcccctctctactgcagcctggcagttatcctgcctgtgtaggacaggcctgctggcttccatcacatagcagttctggaaagaaccttgaatgtcacagctacagaatgcaagcaatcctccctgcataaggaactgctgggagtcttgactgctggtgccaccaggttaagcttaccaacattggttccatagcacattctgaattaactctgaagcttggtttcagtttctcctagcgatagtctgagaatggttttacccagccggggtcctaccgggagacaggcgtatccaagtccctgtggcaggttttgcaacccttgtccatcagcagattctcaaatggccctggatcttgatactgacccctctcatctgtggaataagaacagctctgcccacctggggacctaaagagaaaggtgtccagtagtgcctctgcaggataacatggtgacctcagtcatactatagatcttgaaaagaccttataaagatggtgaagactaaaacaaatagctacattcatcttcaatgtgcagacactgctgcatgaccacaagcatcatgatcagggaaacatgatgtcaccaaaagcacaaagtaagatactggtgactgatcctaaaagatggagatgtattatctgccaaagaattcaaaatagctattttaagcgagctcagcaaacctcaagaaaacatagagaaacaatccagaaatttatcaaggagactgaaataataaaaaaaccaaacagaaatcctagagcaagaaaatacaatgaacaaaatgaaaaatgcaacaaagaacatcaatagaagaatggatcatgcagaagaatttgtgagcttgagacaggctattttaaaatatagagtcaggaggcaaaaaaaaaaaaggatgaaaaggaatgaagtttatgggacaacatcaaaaaagcaaatatttgggtcactgcagttcaagtagagaaaaataaagggacagaaagcttatttaaagaaataatagcagaaaattcccaaacctgaagaaagcaatacatatccacatataggaaggtcaaaggttaccaatcaaattcaatctaaatgaccctgccctaagatatattatattcaaactcaaaagtcaaagacaaggagaaaatcctaaaagcagcaaagcagcaagagtaaagaggcaaataacatagaagggagttccattatggttagcagtagacttctaagcagaaatctcacaggccaggatcattaaaaagtcaggaaacagatgctggagaggatgtggagaaataggaatgcttttacactgttggtaggagtgtaaattagttcaacattgtggaagacagtgtggcaattcctcaaggatctagaactagaaataacatttgactcagcaagcccattactgagtatatacccaaaggattataaatcattctactataaagacacatgcacacgtatacttattgcagcattgtttacaacagcaaagacttggaaccaacccaaatgcccctcaatgatagactggataaaggaaatgtggcacatatacaccatggaatactacgcagccataaaaaaggatgagttcatgtcctttgcagggacatggatgaagctagaaaccatcattctcagcaaactaacacaagaacagaaaaccaaacaccacatgttctcacttataagtgggagttgaacaatgagaactcatggacacagggaggggaacatcacacactggggcctgttggggattgggggcctaggggagggatggcattaggagaaatacctaatgttaaatgacgagttaatgggtgcagcacaccaacatggcacatgtatacctatgtaacaaatctgtatgttatgcacatgtaccccagaacttaaagtataattaaacaacaacaacaacaacaaagaggaatctcacaggccaggagggagtgcaatgatatagtaaaagtactgaaggaaaacagttgtaacatcaaaagttagaaaatcaaatattcagaaagtgggaggagataaagtgtggagtttgtttgtttgtttagtaatcaatgataatctgttatcagtttaaaataacctgcataactgtaagactttttcttgtaagcctgatggtaaccacgaaggaaaaaaacctataataaatacactaaaaatagaaaggtatcaaaacatactatcagagaaaataatttatccaataaggaagacagtgagataagataaaaggacctaaaaaacaaataagaaaataattagcaaaatggaagtagtaatttcctacctatcagtagttcctacctatcaatgtaaatggactgattctccaattataagatagagtggttgaatggattaaaaaatccaaatatatgctgcctgaaagagattaacttcacctgtaaggatacaaatagatggaaaggaaggggtggaaaaagatattccatgcaaactgaaattgtaagagagcaggagaagctatacttatatcagctaaaatagactttacatcaaaaactgtgaaaagagacaaggtcattacataatgataaaggggtcaactcagcaagaggttgtaacaattgtaaatatatatgcacactgaacatggcagaatatatataaagcaaatattaatctgaaggaagagagactgcaacacaataataatagaggattttgaaactacactttcagcaatggacagattattcagacagaaaatcaacaaagaaatagcagatttaaactgcagtctagaccaaagagacctaacagatgtttacagaacattccattcaacagctgcagaaaacacattcttatcaactgcacatggaacattctctaagacagatcatattaggccacaaaaacagtcttaaaaaatttaaaatcaaaattatatcaagtatcttttctgaccacaatgacataaaactagaaattaataatagcagaaattctggaaatattacaaatacataaaaattaaacacgctcctgaacaaccactgggttaatgaattaaaagagtaattttaaaaagctaagacaaatgaaaatggaaacacaatataccaaaatgtataggatgcagcaaaagcagttctaaaagagaagtttatagtaataaacatctacatcaaaaaagaggaaagaaatcaaactacctaaactattacctcgaagaattagaaaaacaagaacaaactaaaccccaaattagcaaatggaaagaataaagatcagagcagaaataaacaaaatagggactttaaaaaaatccacaaaataaagagttttttttttttgaaagaaacaaaatcaacaaacctttagctagactaggtaaaaaagacagtcgactcaaataaataaaatcagaaataaaaaaggagacattacaattgataccacagaaatacaaagaacaattatatgccaataaattgaaaaacctagaagaaatgaattcctctaccacattacctaccaggactgaattatgaataaatagaaaacctgaacaggccagtaatgagaaaggagacttgaatcagtaataaaaagtctcctatcaaagaaaggcccaggacctgatggcatcactgctgaattctaccaacagttacagaagaactaatagcaattcttctcaaagtattccaaaaaattgaagaggaaggaatttttcctaacttattctacaaggccagcattacactgataccaaaaatagacaaaaaaggaaaactataggccaatatccctgaagaacagacagaaaaaccctgaacaaaatactataaaactgaatttaacagcacatttaaaagataattcaccatgaacaagtgggatttatcccaggaatataagaatggttcatcataaacaaatcaataaacatgacataccgcattaacaaaacaatgaaaaaaagtcatacaatcacttcaacagatgcagaaaaatcatgacagagttcaatacctcttcatgataaaaactcttaattaggtatagaagtgatatgcctcaacacaataaaggccacatacaacaaacccactgctaatgtaataccaaatggggaaaagctgaaagccttttactctaagatctagaacaggataaggatgttcccttttgccacttttattcaacatagtacaggaagttctagctagagctattaggcaaaagagaaaaataaaacataataggaaaggaggaagttaaattgtctctatttgtagatgatatgatcctatatacagaaaaccctaaggactccatccaaaactgttacaactaataaaaaactcagtaaagttgcaggatacaaaatcaacataaaaaaaagtagtatctctatatgttaatggcaaactatccaaggaggtgtcagatctctcaaatgaaaactataaaacgttaatgaaagaatttgaagaagacacaaatgggaagatatgcatgttcatggattggaagaatattgttataatgtccatattgcccaaagtgatccacagatgtaatgcgatatctatcaaaacaccaaagacattcttcacaaaagtagattaaaaacaatcctcacattcgtatggaaccccaaaagaccctgtatagccaaagcaatcttgagcaaaaagagcaaatctggaggcatcataccatctgcctccaaaatatattacaaaactatagtaaccaaaataacatgctactggcatagaaacagacaacaggccaatagaacagagaacgcggaaataaatccatgcatatacagtcaactgatttttgacaaaagtgccaagaacatatgttggggaaaggatagtctttcttcaatagtggtgctgggaaaactgaatgaatatctatatgttgaagaaaaactagatctcctgtctctcatcatatacaagaatcaattcagaatgagttaaggacttaaattctaagacttgaaactatgaaactactagaaaacaagatagtggaaatgcttcataacattggtcaggacaaggaatttttgaataagaccttaaaagcacaaccaaaaagaccaaaaacaaataaacggaattacaactaaaggcaaaggaaatcatcaataaagagacaatatttgcaaaatatttgcaatatttgcagaaatatttgcaaaatatttgcaatatttgcagaaatatttgcaaaatatacatctgacacatggttaatatccaaaatatataagaaactaaaacaactcaatagcaaaaaaacccccaaacaacccaattaaaatataggcagaagacctgaacagacgtttctcaaaagaagacatacacataatatgttcaatattactaataatcaaggaaatgcaaatcaaaaccacagtgaggtattgcctcatcccaattagaatggcttatcaagaaggcagaagagaacttgttggcaaggatgtggacaaaagagaatccttttatactgttggtaggaatatatagaaaacagtatgacggttcctcaacaaagcaaaaatagaactaccataagatccagcagtcctactactgggcatgtacccaaaggaacttaaatgagtatgttcaagaaatatctgcattcccatatttactgcagcactttccacaacagccaagatatggaaccaacctaagagtctaccaacagaagaatggataaagaaaatttggtataaagtcacaatggaatattcttcagctatttaaaaaaaaaaaaagaaatcctaccatttgcaacaatatggatgaacccaaaggacattataaaccaggaacagaaagacaaatactgcatgatctcactcacatgcagaatcttaaaaagctgatctcttagaagtacaaagtataatggtggttattggaggctggggtgtttttcagggagaagaaaatggggaaatcttggtcagatgacataatgacagttagatagcaggaataaatttcaacagctctattgtacagcaaggtgactatagttaatgacaatttattgtattcttaaaaaacataaaatttgtggatactatgtgctatcaccacaaaaacaataactatgtgaggtagtacatttgttagctagatttaaccattccacaatgtatatatacttcaaaacatcatacatcatgttgtatacaataaacacataaaatgttatctgtacatttaaaaaaaattaaaaaagcttacattatagaaaaaagagaatacttcttttaaaagtatgcttttagtttagttttacatttctgtctctcttacctcttgatcttttttagtttttctttctagagcctcaaattcatccaaatcattcttttcttttaatttcaattccatttcttctttttctgttcgtagttgttcatagtctaataccagattatcatagtcagcacgaagtgagttcaactcactttctatattctcctattataaacaagaacagattttccaatcagaaaattcaaatattttttgtttccttaataaaatttgaattatttaaataactactttaactttgatttgatatctttctaaagttctacattttggcaaactagctaacttagaatagattattttgaaagaaggagaattttaaaaatatatcaataaagtgtatgtttgcctgtgcctgacagggaattttgaccataagtcctcaagctcctcagtaataaaactgataattgaattccccaatctaactaactcttattttatgtctcagatggttctgaattcaagaatggaaacagagatattatttattgacttctaaagctaatgacaactgtgttttactataaagaggcctatttctattttctatattattataagagaagagataaaccatgagttaaaaaaatacttttttacaccagagattgtaaaaaaaacccaagaaacttctaatgtatgtattaggaacaaaaaaacactttatcaataatactttataggaattaactaacaataataagtagtaatgcaattatattctaaaattcaaatgaaaatgtctattactttatacaactatacatctttaaacacgagcaatctacaaagtaaacacggaatctaaacttactgatgtattcaccaaaattacctctccctgatatattattctatacattataaatgcctgagaattgacacttttaaaatcagtcttgttaccctaatgaagtttaccaaggcaaaacagaaactttacaaacattgtgaatactaagatctgctagtaaagagctagaggcaaaggtttacctactagcacatgtctgccttatgaaatttttagccttcctctaggtgcctgatggttatagagtagaaatgtaaagagaaaagccttcattagagccaaaatcattactgaaattaaatgagaacaagtaacaaaacctaataacaaaagaattttaaaaagagtaaaagcattatatgctgtaaaatacattaagttacctgatttagtagctttgttgctggattccattctatctcacttaatgtatcaagagtgttactgaaaacatcagactctgaacagacagctataattagagaaaaaaaaaatttgtccatgaacatgtttaccaaatttcctaagtcaaattaaagattactaaaaaaattcttatcagagatactaagaacttcaaattaactactatgtgctcagagtatgaataccaaaagtacattaatagatatggtcatttatgttattgtatgaattaagatgatcactggttggaattagtgacacaatacaggatccttaatgaaatataggttaaaaggacaaattctgaatttgagatttgatcattataagtagatttaaaattcccccccaacagactgtactattgaagaaataattttgaaacagattcctatgtcaatgccactcttttaagattagcaaaggcagatgccatataactaacaatttaattgaataataattagaaaataaaaacacctgtctcatgtgtgtttcaactagtgcatcattcttaggagattcagaataaagaacttatgattactttctatttatttatttatttatatttgtttgagacagagtttcactcttgtcacccaggctggagtgcaacgggtcttggctcactgcaagctccgcctcccaggttcaagcgattctcctgcctcagcctcccaagtagccgggattacaggcgcctgcaaccacgcacagctagtttttttgtatttttagaattacttattttaaatcatagtctccattgtaatcacatatgaaatacacagtatttaaacatgtttatcacattaactgagctataaacatagtttctctttataaggatgcttttataattaaacatagttccacttgaaaaaagcactcacattcatcaatttctcgtaataaatttatagaaagcttatgtgtttttgttgttatatttgttggtatattaaattgatctgcatagtttgagttcttcattttgttaattttgccaaggcaccaagtaactcttcgttttcttttagcctaaagaagaagaaatcaaaattatgtcatatagatctgtattcaaacataataaaacaagggaactagtttctatttttgaaaaccattgacttggtagaattcttattaagcctagtttaaaattttattagtctaaggatattgcttaaaaaaaaaatcaaactcttgactctttacttcactctaactaccattttctttttttcctactttgtcctcctcatcatttatccactccttcctcaacacttcagggacccatctcctggttcttaccttacccagctgctgtccttaccactcactctgctttgctagtttctcttcctgtgcctgcctcttaagtgtgtttctccaggtttcatagccaccattcttctcttgactctttactgggtgcaagtatcatctcatcttatttgactctctcggcaaccctagggttgtaatcacatctgaaatacacaaccctaaggttgttgagagaatcaaataagatgagatgatacttgtatcgagtatcaaccttactacatctttttaacagatgagttgggtgcccaacaagtttggagaagttgcataaggttgtatagccaattggtggctgagcccattgtctattacttcagagcctatccatgcaaccattccgtcacattgcctcttaagattacttgttgtccacagaatatactgcatactgtcatgcctctctgagtgctgtccttctgcttgaaatggccagccctttccacaccctgctctgcaaaagccccatcatattcaaatcctcgactccaataaccttcagtttaatgccagttgctaccaaagccacacctggaccttgtcattatctgaaagtcataaactagacctcttgctctcattgccgttgctgtccttccaaatcattaatttagttaatcccactatagctatttagctcatcaggggctatttagctctgttcccttgttgcatgacttttttttttttttttgccatctccctcttggttctcaccctatcatcttagattccatagatcactgtaatcatgtttgaaatttgaggtcaatgttctcaaattatttgacccactctctgtcccttacatgtaccctacacggcacactcaaatggcactgtgttcaagacctttatcagcctcctgagcactgccagagccacacagccagaagaccggctgacaagataaactggacctttaatgttgcatggcaatattcccttcccccttgtcagctttctttttcattacctacaaaggctagcctatttcaaacccttagtatctctgcaaacttatgactctaccatcacctgccatctcagcagaagaattaaacctatttcacaaagaaagtataaacctaaactcctaagagtactacctgcacagaagcctatcctttcctccatgtttgctccaattcaagaggtatttctcctatgttagtccaattctttctactatattcaagattccatccatctaggccacctcaacacactataaggtggctttcatccccatcacttaaattacttttgcaaatgagctctgtgtttctaaatgcaaataatttttgtccatctttatcttatttaacttctcagcagaatatgacactgctgaccactacctccctgaaatattctctccccttagctaccatattcactaggttttattcttaactgtacagctaaacctgggctgctttatggattcttctttctctgccttacccaattggagttttgccttctgtcactttgcctcctgttgccttctctcaacatgcaaccagaacaaactttaatttggatctgtagtagttaatgcccaaattgatatttatatctcaaatcttctacctcatattcacacatttgcattttcaacagcctgacatctcaaacaaaagaaatcccaaataaaacacccaccatttccactgctctttattcagtgtgccttaactcaaccaatattgttaccagctacccatgaagccaaggaattgcttgcaagtcattccggacacctccttctccctttctctgccctcaacatccaaacaatcacaaagtcctgctaagtttaccttccaaacatttctccaatttatccaattcactccaactccagagccacaatctttgcaggcccaagcaatctgatgtgcacagtagctacatctttctcaactataattctgatgtcacacacaaggctgttctttgttgttagcaaaacatcacattcaaatccctcaaggaggtttaaaacgcccctgctactagaacatcttaagtgcaaggaatgcataatgtttcttcacaactccaagcttttgtacatgtaggtctcttttgaaacattcttctctaggtctttcattgggctacttcctgctcaccactcaaccaatagttcttgattgtcttctatatacctctgtacataatgcttattcacattaacaatgtacattagttgagaatatgctgtgtggaaagtgctgtgttgagctaattctacctattatctcatttaattctcacacaacacttatgaggtgagtatcaagctattccacactgctacttccacaggaaaaagcagcaaagtgaattcaagaaattgtccaaggccaagagtcaggaaatgacagattcaaatccaggaagtctagctccagaggtcattctcttatccatgacaccctcacaccccaaaaagtctactgaataaataaattcctactcaattaaaaacaaacaaaaaatcacaccaacaaagtaagaattttgttcactatgttgtttttctttcaccagagtctacattgacacaattatgttgttttatattctacaccaattttcctgagattaatatttctgtttaagtagaaaataatatttccacatattctagaaacctatggcttccaatcacccagtttctctagaatttattaagcagaatattgcaaataaattatttaaatacattccaaacttgttgaattagaatctctacaaataggaatcagaaattggcatttttaatgaatctcttaggtactatgaaacacaaaatcttctgggtttcttgaatatactgtatcaaaggatagaaagtgcatactatataataaacatatagaaataccaattctattctctgtacatcaagtttaagctgtcatcttttaattttacctttaattcctgttgcaacgtgagggaagaagaggtcaccagcatccgtgttaagttttcaattttctcattctgtactttctgaagcaaatctttttcttccaaaagttgggccaattggtctttttccattgcctgagcccgcgtctctaaagaaacctatagaatgcaatattggattatgttaataataaatgtggctaagttttaaaaccttaaagtagcataaaagaataaaatattaaatttgtatatgaactataagaattttaatttcactgaaataaaatatactctaactgtagaacaccaaaatgcagttaccataatcaataatttctcagacttacaataaaatacacatttcttctcatgtaactattctatataccatgtataagacaccaatgctgttaatataactctattaattgcctaagaagatatgaatagtcagaagtcataaaacaaagacttgaattctgatagtaaagatagagatgttctcataagattaccatttgatattttagctcattttaaaaaagatccttaatgcgtgattttttacaaaatatgggaccatgatggttaaaacaaactaaaatgataagtaattatgctatattattagattgctatctaagggttagaagaggaattcaggataacatgaaaacacagaaggtggttctaagtaactctgtagtttctctttttaatcgaattcatatgtatttgtgaaaaattttaagaaatgtctctacttggcccatttgataatctcagattttgcccgttgaaaataaaaaacaaaatctaaaataatttcaagaaccaaatcttacaatttatagtaaattaaactaaaatttttatgagtggatttcttcttctttaaaagtgattaaaaacctaagttgtagcaactcagatattcaggaatgaagagtctctgagcatttgggcaggtctccattctaaattggttctttcaatttaatgaaataaatgattcatacatacctcctctaattgttttttaagatccattatttcttttctataccttttcaggagagcttcatcagttgatacctcattaacataaggagtattcttcatatatttagcagtactggcaaactggaaaaaaaatacgaaagtgctaagtgttcaacacttaaaaaaattcgaatttaattaataatatttagctttcttatattcaagattaaaaaaatcaatactctttctagttggcttaatacttttgaacaaagggaacattctatgtccttataacaatgctctgtaacttatcctgggtgatagtcttcgggagaataaaaaagatatattgagagaacttaaaaacatcagcttattggaatctcatttacccctcaaggtccagtgctaacgcctcctctactctgaagttttgcttctagccaaaaatatctctccttcctttaaactctatactagttattaaccacttaactactaatcaaaggcaattatgttgcaagacaagtgttatgtgccttgtcacagaattcattaattctgttaagccagggactctagtttctctttgcacctctgacagtaccttgatctggtgctcaacagctatttaaagcaatgtttctcagagtataagtaccataagtaactttaggtgggtacaccaaggtgaccattagataacattgaatccttcattgagaaagctaccctactgatatttctcatttttcctttccttttttttttttttgttttttgttttgagacatagtttcgctcttgttgcctaggctggagtgcaatggcgcgatctcggctcaccgcaacctctgcctcctgggttcaagtgattctcctgcctcagcctccccagtagctgggattacaggcatgtgctaccacatctggctaattttgtatttttagtaaagacagggtttctccatgttggtcaggctggttcctttcctttttaaaatagaaaatgtaggccttaggctcagagaaaatgaaggcaacagttaactaccaggaatttcagaattattttgttatacagacagacacacaattttttttgttaccttctatttgtggcaagtaataatagtttcccattgataggactaatattaaagtttccttttacaataaattaagtacaaaaagtgagttattttaaaaatatcaagtcaatttcagtaaaatagtgttgggtgtggcaaaaattatgaaggtaagatacaaataatcgaagtctggcaaaattaaattaagaaatgctatttagtagacaacatatcgattataacaggcgagttaattaaaaaaaactatgcttaattttagtaggtaatgttttcttcttcaagctgatcttcccctatattaagctgagataaaaatcaaactcacctggagagcagtaagtgtttcatcaaaagatactggagtaattgtgcagataatacgtgtctttgcatttcctcccaaggaattctggagaattcgtgttaacttgctatctcgataatttatgaaaccacttagcaaggaataagtttacaggagaaaaagattgagaacgtttatataataaagtagttggtttttaatgcagaactcttaaatcagccagagtttcaaaaattagtttacaagttatatgaggcagattaaaactactaaaaaatatttaaaacagaaagtaaattcagtagattataatcatatgtataagtttttgaatatatggaagaaatcagtacatttgagtgtcatcgaaatgttgcaatgttcaacctaatgaaaaatataagaatcagtaggtaagtgcacaacgggataaacttacccaacttgtccatcactaagtttcttgatcacttgtcccaaaataaataagcttcgatttatattacagccttccttgagccgcacacctgaatttattaaacaaatatgaaaactaaacttgactccttttctagatgataaacttatttatcactaagttaatgagagaaattagagggcagatgctaaagtctatgctctggtttagacatgagcccatctttaatatcagtggtagaaagagctctctccctattggtcccacttcaagtgaatcagaaaggttattacctgagaaaaatagtaaaaagaaaaaaatgaagagggagggaagaatgcagggaaaaaaaacctgtttcctgaaagagcttctctagctcttcagttcaaatcaatttttttccaacatctaaatataggcaactatgaacttacaaccaaattagcctctaatttcttatttttaaattgttaatatgctcacacggttcaaaaagtttaaaaaaaaagtacactttgaaaaagctcccttccacttttatccccattcaaccagttcctatacctctaccaggaaaccactgttattagtttttttctttagagatttttaaaaatacaagttcgtatgtatttatttccttccttcttcactgatatcaatagtaacagtccatacatactattttgcactttgctttttctcacttggcaacatatcttggaaaaatttccatatcggtaaacactgatctttttcattcttttttaaagtataaaattccattttacggctgcatcagacttcattcacccaccccatcccctgttgaaggacatgtaggttttcagtctactgcctatacaaaaaaaattgtaaaaataattttgaacagatgttatttcacaggtgcattaattagctattgctttaacattactacctaaccaaccggctaaaacaagcatttattttttgttcacaggtctgaggatggactggtttggtggatgtaggctaggctcagttgagtggctctacaataggttgcagaatgagctcaagtctgttgaacaaacttctaatcttccttggatcagcagctcttctaatggcaagagtgcaggtgcaagctaaaccatttaagcattatgaactattcatttatatcctttgcccagttttttgttggtttcttttaagcttttaaggcatctggactttgtatcagttacaaaagggttttcccactgtaagttgacttccaacaatttttagtttttttatattgaaatttttgagctacttataatgcattccttggtgtatgatatatggatccgacttaattttttttcccaaatggctatcaattaatgaataatctatcttttctttacaaatttgaaggaccatctttattgtattctaacttctgtatgtatttgggactcttgatggattttctattctatttcactgggctgacaattcacacagttttaattactatggcattataatatgttttactatcttatagtaagatagtaaaatcttaaattccactttctgctttttggaattttcctggctactcttgtctgtttttatgtttccatacaaattttaaaatcatcttacctaatttaaacatgaaaatgtactcttgatagtcttattaggattgtgttaaatctagaaattaacacagaggcctgatatccttgtgattttgaatcttttccatttaagtatgcttctccattttttcaagtatttgtttgtgtccttcaagtctgatttacaagttttcttaggccgggtgtggtggctcacacttgtaatcccagaactttgggaggccgaggtgggcgggtcacttgaggccaagagttggagaccagcctgaccaacatggcgaaactctgtctctactaaaaatacaaaaattagctgggcgtgatggtgcatgtctgtaatcccagctacttgggaggctgaggcatgagaattgcttgagcccaggaggtggaggttgcattgagctgagatcgtgccactgcactccagcctgggagacagagtgagagtctgccttagaaaaaaaaaaaaaaaaaagttttctttatatcagtcttgtacaaatctttgttgagtttcttcctagatatcacatcttttaggttattataaatggagtctttttgtctactaaatattttaacttgtttttattaatattttaacttttaaaaattaatatctgcatattaattttgtaccacattatctttcttaatttccttattttgaaagtttaaatggtttttatggaattctcatgggctttcctgctgtacaatcccatcaattgtataattttcattttttaattgatgctattgtagactaaaataaaaattaagcagatacagatgctgatttctatgttaaacttttatcagaaaatcacaattaatgattcattattattaataatgaatataattactttatcaatttctaaaaatgcctggtagtactttttaaacctgtaaaataggaagacattaagactaacatatttcatgagttttaattacctgcagcgcctgtttgagcagctctttcactgcctgcaagatcaaccaaattctgtaagatagataaaaataaatccttagggcagataatttgaaataataaaattcaaactactgaaagaacatttttaatacatggtatatctgaatattcgatctgtatccatgtctcccatgctactgtttaggcattcccttttttctctgagtcaaactgttctctatctgttcctttctttatatcttccataatgccaccagtataggttctgtttcctatacaaggtccaaaaacttactatggcaaatataattctttataagctggcacttgcactgctccaactttgtatttatccatcccttattcttacctctagctgaactactcactattccccaaacaccccatgtacttctacacctccaagcaccagctttttgctatttcctttattcagttagttctaatgttctattctgtccttattctttattcaagaaccaggcacaaagattatctcctcagcatagctttgcctactttatccttcctccccgccagatttcagatgaactgctccttgaactgcataaccagaaatctttataaacatgacttatagatacgacttacatttatagcacttattttgttgggctagtcatgcatgctagctgtactatgctgtagcaataccatgactttactgtggcatctttaagagctggacctctctttcatttcacaaatattactgaaaagaagtggctgcttattatgctccaggaagtacatcaggtgctagggctacaaataaataaggtctctgctctcatggagcttacattctacatagaggaggaggctggtaagaagagataaaaagacaaataagaaacatgttgtgataagtgtaacagagattatttaaatagagctggaaaaggggccagtagctttaggttcataggactggatagcagtggaaggcttgtcattaagctgcgatctgaatgacctgagaagaggaagctggtcccaaaaagatcaagggaaacagtagtctagacaaaaagaatagccaaaacacttagtcacaaagcagaatgtgctcagtgtgttcaaaaaaatagaaaaggcagtgtggcacagttggtgaagtgaagacaggaaaagacagaataagagaagtagacaggggccagattatgcaggactttttaagtgagatctaaaactctgaaatgtttatattcaatgagaagccattgcagggctttatgcaagggagtaatagaaccctgccttgctagattggggaagttctcctggataatatcctgcagagtgttttcctactttgttccattctccctgtcactttcaggcacaccaatcagacgtagatttggtcttttcacatagtcccatatttcttggaggtttgttcattacgttttatcaaattcaggaaatacagagaatgccacaaagatactcctcaagaagagcaactccaagacacataattgtcagattcaccaaagttgaaatgaaggaaaaaatgttaagggcagccagagagaaaggtcaggctacccacaaagggaagcccatcagactaacagctgatctctcagcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaatagccactgcaaaaacatgccaaattgtaaagaccattgaggctaggaagaaactgcatcaactaacaagcaaaataatcagctaacatcataatgacaggatcaaattcacacataacaatattaactttaaatgtaaataggctaaatgctccaatgaaaagacacagactggcaaattggatagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctcagagacctacaaagagacttagactcccacacaataataatgggagactttaacaccccactgtcaacgttagacagatcaacgagacagaaagttaacaaagatatccaggaattgaactcagctctgcaccaagcagacctaatagacatctatagaactctccaccccaaatcaacagaatatacattcttctcagcacatcacacttattccaaaattgaccacatagttggaagtaaagcactcctcagcaaatgtaaaagaacagaaatgataacaaactgtctctcagaccacagtgcaatcaaactagaactcaggattaagaaactcactcaaaaccgctcaactgcatggaaactgaacaacctgctcctgaatgactactgggtacataacaaaatgaaggcagaaataaagatgttctttgaaaccaatgagaacaaagacacaacataccagaatctctgggacacatttaaagcagtgtgtagagggaaacttatagcactaaacgcccacaagagaaagcaggaaagatctaaaattgacaccctaacatcacaattaaaagaactagaaaagcaagatcaaacacattcaaaagctagcagacggcaagcaataactaagatcagagcagaactgaaggagacagagacacaaaaaacccttcaaaaaatcaatgaatccaggagctggttttttgaaaagaccaacaaaattgatagaccgctagcaagactaataaagaagaaaagagagaagaatcaaatagacccaataaaaaatgataaaggggatatcatcaccgatcccacagaaatacaaactaccatcagagaatactataaacacctctatgcaaataaactagaaaatctagaagaaatggataaattgctggacacatacaccctcccaagactaaatcaggaagaagtgaatctctgaatagaccaaaacaggctctgaaattgaggcaataattaacagcctaccaaccaaaagaagcccaggaccagatggattcacagccgaattctaccagaggtactaggaggagctggtaccattccttctgaaactattctaatcaatacaaaacaagggaatcctccctaactcattttatgaggccagcatcatcctgaaaccaaagcctggcagagacacaacaacaaaagagaatttcagaccaatacccctgatgaacatcgatacaaaaatcctcaataaaatactggcaaacagaatccagcagcacatcaaaaagcttatccaccatgatcaagtgggcttcatctctgggatgcaaggctggtttaacatacaaaaatcaataaacgtaatccagcctataaacagaaccaaagacaaaaaccacatgattatctcaatagatgcagaaaaggcctttaacaaaattcaacaacacttcatgctaaaaactctcaataagttaggtattgatgggacgtatctcaaaataataacagctatctatgacaaacccacaggcaatatcatactgaatgggcaaaaactcgaagcattccctttaaaaactggcacaagacaaggatgccctctctcaccactcctattcaacatagtgttggaagttctggccagagcaatcaggcaggaggaggaaataaagggtattcaattaggaaaagaggaagtcaaattgtccctgtttgcagatgacatgattgtgtatctagaaaaccccatcgtctcagcccaaaatctccttaggctgataagcaacttcagcaaagtctcaggatacaaaatcaatgtgcaaaaatcacaagcattcttatacaccaataacagacaaacagagagacaaatcatgagtgaattcccattcacaattgcttcaaagagaataaaatacctaggaatccaacttataagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcattgccatccccatcagctaccaatgacttttcttcacagaactggaaaaaactactttaaggttcatatggaaccaaaaaagagcccgcattgccaagtcaatcctaagccaaaagagcaaagctggaggcatcatgctacctgacttcaaactatactacaaggctacagtaaccaaaacagcatggtactagtaccaaaacagagatatagaccaatggaaaggaacagagccctcagaaataatgccacatatctacaactatctgatctttgacaaacctgataaaaacaagaaatggagaaaggattgcctatttaataaatggtgctgggaaaactggctagccatatgtagaaagctgaaaccagatcccttccttacaccttatacaaaaattaattcaagatggattaaagacttaaatgtgagacctaaaaccataaaaaccctagaagaaaacctaggcaataccattcaggacataggcatgggcaaggacttcatgtctaaaacaccaaaagcaatgacaacaaaagccaaaattgacaaaatgggatctaagtaaactaaagagcttctgtacagcaaaagaaactaccatcagagtgaacaggcaacctatagaaagggagaaaatttttgcaatctactcatctgacaaagggctaatatccagaatatataaagaactcaaacaaatttagaaaaaaaaaaaacaaacaaccacatcgacaagtgggcgaaggatatgaacagacacttctcaaaagaagacatttatgcagccaaaagacacacgaaaaaatgctcatcatcactggccatcagagaaatgcaaatcaaaaccacaatgagataccatctcacaccagttagaatggcaatcgttaaaaagtcagggaacaacaggtgctggagaggatgtggagaaataggaacacttttacactgttggtgggactgtaaactacttcagccattgtggaagacagtgtggtgattcctcagggatctagaactagaaataccatttgacccagccatcccattactgggtatatacccaaaggattataaaatcatgctgctataaagacacatgcacacgtatatttattgtagcactattcacaatagcaaagacttggaaccaacccaaatgtccaacaatggtagactggattaagaaaatgtggcacatatacaccatgaaattctatgcagccataaaaaatgatgagttcatgtcctttgtagggacatggatgaagctggaaaccatcattctcagcaaactatcgcaaggacaaaaaaccaaacaccgcatgttctcactcataggttggaactgaacaatgagaacacgtggacacaggaaggggaacatcacacaccggggcctgttgtggggtggggggagggggggatagcattaggagatatacctaatgtaaatgacgagttaatgggtgcagtataccaacatggcacatgtatacatatgtaacaaacgtgcatgttgtgcacatgtaccctaaaacttaaagtataataaaaaaataaataaaaataaaaaaacgtaaaactggaaaaaaaaagagaaccttgcataaagctcagcaatgactctcacaatggatccactatgactactgggtggaggatggattgggaaggggcaagagcagctgcaggcagccccatcaggcagctggggcaggaatctcggtgagagataataccagcttgggttagggaggtggcagaggagactgcttgtaagagaagcagtgaaggggtgtcttgtttattgtttttttaatctcagagcccaacaccatgctcagaagacaataacaacttagtaaatattgtgagtgatttgaaagaaagtcaaagctttacgttatttctctctgtggagatttttgagactaggcaggtaaatatgtattaccagttaaggaggctaatttttcttgcacagtgtccactacagatgacacagatacataataaaagggcaaagtggtaatgaaggcagcatgagtgaaggttaaagatgagaacaagcattcatattcaaagatactcagaggcccaatctatgagggaggagttcatgtagagcagaaggaaataaagttagattggttaagagtggccaaatcttgccccaggaagtgatatacaaaagcaatggttagtatattcgaaatccttatgatgacttcaagaaacaaagacaagggtcatggagacaaggttccaggagactgacatagtaattcaagagagatgagaaagtaaatgagtgtagcacccatggaaatgtttaaaggtaggatcagtaagaaatgggacaagtggacaaagagaaaggcagaaaaagatgagtcaaaattgacttaggtttccagcttaggcagctaggataatgctggttttactggaaataaggaatattcactatggtaggaagaaaatagtttcgttttagacatattaaagtttgagataatgatgggacacaattataaccatctttaggaagacatgaattagaattcagagactataggtaaaatatttggcagtcatcaacatggaaatgatgacagaacatttgagagcaagaacttgagtaagaaacgtcacagaatacctccaagtttttttttttttaattatttttttaggagggtagggaaaaagaagccagggtagaaaacagaggagtacagctaagagaaactggatattatcatcccaccaaggccaggagataatcagaaaagagccacctctaaagagacagagatgactctttagagacttctttccaagaagattcttagagtaagtgggtaggctggagggttggaacagatggaacacaaatgacagagcatcacgtaacatgaggaaaatcatcaagtagatcactgaatatgccaagagtattaaagctaaattattaaaagttaaaattatatgaaatatcacagtcttggatgagaaaactaaagaggttagggtttggttttttattgttaaattaaaacaagattaaagtctactaaaataagttatacaattttatagcaaaatagctaaggtgaaattaggattgaatattaagtaattaataatctaattttataaaatctgaaaatgaataaacatattatagattgcttttttccctgaagttttctaatcaaataatcttaaatcatatcccacatcaagctaaagaatttaggccctaaaaatgcagaataaagcaatatggtaaaagatagaaaaggagcaagaaagaaacagcaataatttagtgtggaaagaaggaagtgaaggtttactaatgtggaatataggaatgtttgcataatgcatatattcgcttattcagcaaatctatattagacataaaataggtataatgtgttggggctaccaggatgaatgcagtatcactcctcaatggatttacagtctaaagtactacgtttacaatacaaaatatattttattgttgtacttaagtaaaacctaaagtaatgtgattactttttaaccatccaacctagatttttgttgatcacataagtctaaattacattggctgagattttacaaaaagaccctcaaattctaagatgatctaaagtgttaaatgtgtatagaaaaaaattctactgcattagtggttagaaaaaacatcaattcctataaccctatagccctgacatttaaattttaggagatggcaaccatgacataacaggaagaaagatcctctgaatttttcctacgacattttagctaggaatttgatgatactgacaagactaagcagacaatttgtagatttcctcccacatttagtttagttaacagttcttattaaaccaaacatccagcaactaaattaaattttgttttggcccatacagtacattattatggttcattaatactcaccaaatgggataccttaacagatccttcacaattagaaggttcacccttctctctgctttccaaaatctagatagaaaaggcaagctgtagaaaaattagtgcattcttacttggaaagatctaacagatagatagaattacctaccatcctaaagatggtatgagaacgactgcttctttgattcatttttgtttctccataatgcctgctctctgtaaaaatgagttatatttcagctgcatatataataaaatccatagaaacacaataatttttattttaacttaaaaaagtatgatttgaggtccaaacgtgcttgattgaaaagatagtttttacaagtgttctaaagaaatacagcataaagtcttactttctccctttgtaatccatttcaaagccatttctgatgtatatacaacttcttctgtgagatcagcaacatacacattcctctgaaacaagtttaattatggaaagattagagaaatagaagtcacaagtttgcttttcaaaagaaggtgcaaactattatagaattcatttgtgaaagttaaaagtggcaaatggaaccataattctgtaggaatgtaacaaataattctatgaatacccacaatttatttcacataccaaagcacaacaaattctaacctgatacttccaacttgctatttttacacttaaaccaaaatattagagctgtcagtattttaaaactattcatattgtttaaaagatgaatataaatacttcaaaaaaaccctcacatactatagaaataggagacactttaaaaactatagaaattaaaggtaaacattcaagaacaataatctcaataagtcagtcaattttaaagctcccttaagtctgctactcacattgacatcttctcgaataattaaaggtttcattttttgagtgccacagagtaaatctgtaatggtttcattgtatatttccatgtaagatacacgtaagagaaattccctatcaggaaactagaagaaaaaaaattatataaaaacaccaggaagcatccaattgtgaaaacctaatgctaaatgctcatgtgcttaaagaggtaaaatgtatgtaaaacaaactaagaaaccccttggttctactgttgacaaaataatgaacacaaaaatataaaagcatcgttacagaaataatgaaaagtgaagtaccataaagctgggagaacaccaactctaggctcaaactctaggctcaaaataaaaccctctcaaaagatgttcttattttaataaaaatgctaatttgaaaccaactaactcggttgcctattctggctttctgcttcccttctttttttacctacatccactttctactgttcctttataatcactgatagttaaatggttaggtggagctaaccattctgataacattttcttgttccttaatgcctactttttgttgagagtattattgttgcagaattcaagagaaagaataaaagaactttaagctttataaagtaagttgtggagataaaagtgaatctatgctatgcctttcttctttccccatggataatcaaacaataactgtaaatctacttcctttcatctttacaagagaaatacactaagactggtacccagtttttactagttttacctgtacgtactagaaatccagttaagttacttaccttcttaattttttggaaaatgtcatgaattgccctgggtataactcccaaatgatcttctgaacccatcatggtatatgtttttcctgaagcagtctgtccataggcaaatatagtacctgcaaaaaacaaaacacacatacgcaaagattaaaaacaaacctataatgggtaaaactatgcatgcttgttgcacagacgcccaagactaaaatgtttctgcagcattgagtgaatacaaaccattgtagccttgtatggcagaatcgatgattggtgctgctatttcttcatacacatttttggtagtttcattaccatgaaagacacgatctaaacaacaacaacaacaacaacaacacagaagttaaatcaaatgagtccactgtgttttcattccaaattagtaattattcccaaaagtaaaactgtcagaatgtaggatgatcaactatttaagacacagtatttttttcaactttttggttctctgaaaatacccttccctaaggtaaaatgagttcattttcacacacaaaaaatacactacaagtcaacttttctatgttctttcaagaggcaataaggtatagtgtttgcacatgggggtctggaatctacctagatgcaaattagataactgtgattataactgttttaaatgccaattggttaccttacttaaatacatgatggataaacaattttgtttccagtgaagcagtttatagaaggcttagtctaatctttagtgacaaatctaatattattgataagccttttgtacttttaatagcaaaaggataacaaggtaacttttgatgctattataagcttaccaaaattgaaggatttacttccatcaacttgataaatgacattattgtcagttttccagtaaacttgggcagtttctccaagtgattcttctctaaaagaataaaaacaccgcattttaaccagtcataaaagtcatgtcataggaggaataattgaaaagatttcacctgctaaagaatattttgaaagatagtaacataagagaatgacagaaagtccatctttgaggattcaactcttaaatggagcttcagtgaccttctgccgcctcaaaagtgttttcttgtgaaggctttcattctcaccctctcccccagtactggtaaacaaagggatggattcaaaatgcaactctgattatgtctgtcttgcttaaaattcttaaaaccttttggaaacttatgaaatcctcagcagggcacgagtcctagatcatgtcatttctctcttccattttcctctgaattcctagatacatcctaagctctacctgaaggtcttccccaaatgacagatgtaacctctctgtgcctggaatactctgacttccctttccattaagtaacatagggattatttcactcatgaaaagcgtcaagacttttctgacaccagttcaccccacgggaagctttcgtctctgatgggctaataactcctctagcaaacattctctacctgcccatcataacacttgtcaaaaggtatcctaatggtttctttatgtagccgtttaaggcattagataatgagctcctcaaaaataggaaattcctgatcttggtatttgcatttattaaaccccgtgttcaataaaaatttctcacacacacaaagtgttagcatttcgggtcgagggccagaagctagtgaagcaaaccgatttcatttattcctcttcctgctttttctccctagcacttattacctacatatcaccacttaacatcctacattttcaactttactttctgtctcgtcccattagaatggaagagccactgggcaatgacgggagtgtctgtgttgtacaaagtcactaaaaaaaaattgataaatatttgtagaatgatcttgagtgacgattgaatgtaatgtgacaagacagactagcccttgtcttcagagggtctggagacagcagttaggtgtaaaatgactaactgtgatgagggccaggaaggcacggtcccatacgacttctctaggcggggaatggggcagggaggagcagatgccgcaaggcagagcagcacagaagggaaggtctgtatgtcagcgagactgagttaaatttaagtgaatctcgcagctggaaagtatcttctagatctccgatcctcccctgtcactttacagaccctgaaacgatggccagcagccgagtcactagacagcagagccgggaagcagcggctcctggaaacatcgtaggcctcgcccctccggctcagggcggcgccgcaggcccagcgggcaccgggccgtggtgtggcccccctacctgctgttcagcggccgcactcgcacgcagacggccacggctccttcctccgccatcctatcaggctgaactggtcccaggaaaatggccaggaccctccgcggccggcacttcagggctcacaggccgccccgcctttaaatttaaaatttcccaaacgccgcatctgattgagccgtggcctcgtgacgtcatgggccattccacgtgcggagcagcgcgggggacgcaaggcgggcggcgtgaccactgctaaacaggagaggggatttaaagggcccagcagagagtcggaggagagggccgaagggaggggctcccaggagtgggcagagagtggtggtcctggaataccagaatactattatctgccaaaagctagcgaacgtcatcctccaccccatccttaaaaagtttggaacctgtagacgaaactaggtagagatacatgtatttttcactacccaaacagaattgccgtcttttaaagaaactgcaccaacagtttaaaataaactttcaacagcaagagttgaaattcgctgtccagtccagaaacgtgacaagcctgttgtgcgccttagaaaatctgagtttaggcttttctcctgtttctctctctctgtaactcgtttccattagctgtggcttcctcagaggttgaattagggaaaataaataccgaggactgaaaaactcattgagtaatgggttgatactttttttttcttcttttttttggaaacggagtctcgctctgtcaccccaggctggagtgcagtggtgcttatctctgctcattgcagcctccacctcctgcattcaagtgattctcctgcctcagcctccccagtagctgggattacaaggtgcccgccaccacgcccaggtaatttttgtatttttagtagagacggggcttcgccatgttggcaaggctggtctcaaagtcctgacctcaggtgatccacttgcctcggtctccaaaagtgctgggattaaaggcgtgagccaccgctcctggcctggtttgttacttttattaactaagagggaaagctattctaaatacagtgattttttcccaaaaataatgcttattttccctttcttctctctctctcttttttttttttttttttttttaaataaacatgagttcttgctttgtcacctaggctagagtgcagtaggctgaacacagctcactgcaggctcaactcctggcctcagcccaagtggggttcccaccttaacctcctgagtagcttggattacaggcacatcacaagcccagataatttttaaatttttttgtagagacggggtggtggggggattagggtagggagtggggtctcacagtgttgcctaggcaggtcttgaactcctaggctcaagcaatcctccttgccttggcctcccaaagtgctgggattacaagcatgagccatcgtgcctggcctagctttttatgtgtactttagaaagctatccaagatgtttcatttattaagagaaattcaaggtgcacggttatgtacacagaatatgtctggatatacatacataatttttggaaagatacacagaatatgcctaatttccttgcagagtgaggactgagttagatggtagactgagttagatgaaagtagtttctttcaatttaaagaaactagtttatagataagaacagtaaagaaaaatgagtctattcattcaagatttgttttggttaactagctgtgaggtagtataaacaactcttttttattgctagactgtaaagatacttggttgtatctagtaagaaaatacagagttaaggaaggtatattttaactgttgtttttgttttaattgtgggcaaatatgagacagctgaaggcaaggaacctatgaagaagaagggagatgtgattaatcaaaatttctaatgagacaagaggagattggttcacgagtaaagagaagtcatcagcctttcatagttgtgcttatgatcgttgctatgactgtctttttttatcatcacagcaggtgacatttattgaagatttactatatgccaggctctctattatatgctctctatccaattttttcatctgactttccaaattgttcatcaagaaatattcattgaacaactgttatgtgccagatacggttctaaggtcaggaagcacaacagtaaatagaatagacacagtacctgttgttgtagagttgctattctcttagaggagatgggtaatacagaaaaatctcagtctctctctctctctctctacacacacacacacacacacacacacacacacacacacacacacataatgtaatgattaataggatcaggagacagagagagagtgataaggtgggttaagagtgctagtttcttatgaaacacattcttgtgggaagcagcagacaatacataacaaatatatagtaaaataatgtgttgggaggaaggtttattttagatgagatgttcaagaaagacctgaggaggtgacctttgaagtgaaacctatgtgagaagagtgagccagacttgggaggacaagagaaagggcgtaccagacagaggaacaagtaagtcaaagaagccaaggcttgatcgagtttgtcatctgtctgagacacaaaggggagggccctgtgactgaagcatttgtggcaatggagagaggtaggcaggtccaggtccaggacccatggggccttgtgggctgtgataaaatgtttggatcttattctcaagggtgaggggaagcctatggagggttttaagcaagggggtaaaaagggattcattaattccttcaaacaagacactctttatttcactatgaaaatagaagcttccagaaaagactttgccctaattcctgtcaatctggctactcactatgtgcatttgtgcttgcatactcgccttccagactgtaactttataaacatctgtgtgttttccactctggaaactctccatgtgtgcactggatacagtcctctccttctcactctctgtcctgcttgtcattttctcctgctctagaaaaccagtcttaacagcaaacatatgccttaattcctcccatattgagtgtctaatatatatggcaaacttaaaatgtctaataccaaattcatgctcttcccctcaaaatctgctcaatcagcagttttctgcttctcagttgttggcaagtccatccttccagttatccaggtgcagactctggagccatgctgctcagcttctcacctgaaaattctgtcagggccaccttgagaaaatttcagactatgaaaagtttgtcacaacttacgcttcagctacctggtccgaaatatcatcatctggcactgagctaatctcagtgtttccacccttgcccacccccactgccagtctgttctcaacacagcaatttgaatgattctgtgaaaatgtgtcagatcatgtcactcctctctcaagacccccagtgccacaccttcacccccaccctctgatttctctcagaacaaaacccaacgtctttcagttgtctcccaagcctcacatgatcttgccctttgtttgtgctctggccttacctcctaccactgtccctcccctttgctctccccactccagccacacgggccatgggcagtttcctgaatcccagacaaaccccctcttgagacctttgcactggctgctgtgtctggatggaaggctttcactccagatatacatgtttccctccttcccattgattccagtgtttactcaaatgtcaccctctcatagctctctctctataaaacaccaactccattgtatgttacttctatttcttaaatcttcttcttaaattagttacaagattatttgtaacttttagacataatatgtgtatgagtattaatttatgtatatatgtctcctcccactagagtgacatagtttttgtttactccttgtcccctgtgtgtacaaagatgcttggcatagagtaaacgttcaattaaaaattacttattacttaagtattactcaaatacttattggcataatttctggaaagatacacagaatacacctagctttctttggagggaaaggactgagttggaaaacagattcacctttcattttatattatttcataacaatattttaaccacatgaatattagtttctctcaagttaaagaaattagttgacataaatcagtgtgtaaaatggagtctactcattcagatttgttttggttatctagctctgagctcatagagattatcctttttcatgactaaattgtgaagaggcagggctgcttctaataagataatccagagtattgtggtgtatacatactatggaatactactcagccatgaaaaggaatgaaataatgggattcacagcaacctggatggaattggagaccattattctaagtgaagtaactcagaaatggaaaaccaaacgtcatatgttctcacttataagtgagagctaagctatgaggactcaaaggcataagaatgatacaatgaactttggggacttgggggaaagggtgggagggggtgagagatgaaagtctacacattgggtacagtgtacactgcttggttgatggctgcaccaaaatctcagaaataaccactaaagaacttattcatgaaataaataaattaaaaatcaataaataaaataaaaggataataaccaacatgcatggaactggaggccattgtcccaagtgaaatgactcagaaacaggaagtcaaaaactgcatgttgtcacttataagtgagagttaatcaatgagtacacatgaacattgtaatagtctgttctcatggtgctataaagaaatacccgagactgggtgatttatagagaggtttaattgattcacagttctgcatggctagggagccttcagaaaacacaatcatggtggaaggcgaagcagaagcaggcaccttttccacaaggaggcaggagagtgagtgggagcaggggaaatgccagacacttataaaaccatcagatctcttgagaactcactcagtaacagagaacagcatgagagaaaccatccccatgatccagtcacttcaggtccttaccatgacacatggggattatggggattaaaattcaagatgagatgtggtggggacacagccaaaccatatcagacatatagagtgaataatagacactggcaactccaaaaggtgggagagtgtgaggggactgagggatgcaatactaaccatttggtacaatgttcactatttgggttatgggaacactaaaaacccaaatttcatcactacgcaatatatccatgtaacacaactgcatgacatgcacagatgtaccccctaaatctagaaaatatttcaaaaagagaaaaaagaaataaacatgttctaataaaaaagagatggatcaagtaaatctgactaaaaaaaagttaaaaaatataaaaataaaaagaaattgagtggtaagggaaagcataaagattaaataacctatctaaagttatggaacttctggcaagagaggcttaacatttggatgcctaccatttctctgataggcaatcgaaattttttgttaatttttttttttacctgaaagattaatacctgcatatggtcaaaagattcaaatgaacagaagattcacagtgaaaaacaaatcttcctacattgactcctaaggtgtcatttcacctccccagaggcaactgtgccatttcctaaagtgttctcatcaaaataatttacagataggcacacatatacatctttttctatattgcatatcttttacacaaaaaggtacctgtcatacatgctgtagtgaactgtgcttaaatatgatctttatgtaagtgttttcattcagtttaggaagaaaagtgaatttctgaggcatattaattgcacacacttttatgttgatgtttcaattactgtttttttccccaactgtgttatttatgctgaagctgcagagggcactgtaatctttcccaaaacatggcatagccttgaatggtattttgaagagtgtgaatatggtgcaaactgtaggattcggagaagctactgatattaaaaatatacatcaattcaaattactcacctgttctctctcattttaatgcatttcatagaaaattaatagtaatatacttattacatataatcaccttcaatggggtaatttttatttcaaattttattttaggtacaggaagtacatgtgcagatttgtcacatgggaatattgtgtgatgctgaagtttggggtatggatatcatccatagtgagcatagtgcctgataggtagtttttcaactccctcctccctccctctctctcccttctagtagaccacagtgtctattgttcccatatttatgtccatgtgtggtaaatgtttagctctgcttataagtaagaacatgcagtattttattttctgttcctgcattaagttgcttaggattatggcctaaataggagtaatttttgtttaacagagagaatgcctaattttcaaagcatctatttgaaagacatctatttggagacatctatttgtaatgatcacagacatagtatttctcaccttttaatcacagtaacaggggatttgtatggcatcatgggaactgctctggcctgggtcagtccaaagactatttctaagctatgctgcattggaaaatcatttatctctgtgtgtcaccattttctcatccatacaatgagataattggatgagaaaatttctaagggtttttttcagcttcaataattctataatgtcttcattaaggaaagaaaattgaatcgctaagagaatagattttaagttactcacacaaaaatatgtgaggtaatgcatatattaattagcttgatttagccattccacaatatatacatactattaaactcatattgtaccccataaatataagtactttttgtcagttaaaaaaaataaaaaaatttttaaaggaaacttgttcaaattgagtatggatgagtgtaaaattgaatacagatttgtgagggagtaggaaaagtgatctgtgttaccaagaaaatctaagatagtcacaatgtggcagaggatgatggcagcccaccaaaatctattctcttctttctggccagaaagcaagattacattcccagcctgccttgcagttaagggccacttctaggcctatatagaattccaggggtgcacttttcctgcctcatccttggtgagcatcctttctccttttcttcattgattcttccaaatcctgaccactttcttcaagcccaggtttcatcttcatctttattgagaaatcaggaccatcaggcaagatgtctcaacttccaggtttcccaccctacctcctgcacttctactgatttatatcctcaccaactcttccctcttttcatgcacgtccagagtgaagtgtctgtggtgtctgagatgagcccttccatttatgtccttggctcctttctctccagtgtcctctacatccttgctcaggcagttattttctctcttatttcagaaaaatgctagaaaataacaaaaagaatcatctgtaatttcaccttaaaaattatctaaattgcctagtgaatgttccttctattacccagtcatcaaatttcatcttccctaaggtaatctatgttaattaaatttatatttcttgaatatatgcaataaatctatgtggataaccagatgttttcatattttcaagaataagattattctgtaattgatctaaaatttgctttttacactaacaaatcaatatatagatctgccttttatattggctgcataatattcaattatatggcagcattatagtttattcaaccatttctttcttttcttttctgttttttgttttgttttgtttttttttggagatggagccttcctctgtcacccaggctggagtgcagtggtgcgatatcggctcactgcaacctctgcctcccgggttcaagtgattctcctgcctcagcctccccagtagtggggattacaggcacccgccaccatgcccagctaatttttgtatttttaatagaaacaggatttcgccatgttggccaggctggtcttgaacccttgacctcaggcaatccacctgcctcggcctcccaaagtgctgggattacatgtgtaggctaccgcacccggcctcaatcatttctttatgtatatttagattgtttctaattttcaatattgcttataatacaaaaatccatctgcatatgtctttccatacttacgcttttattttcataaactagattgctagaagctaaaatgccgactcaaatgatgtgcttgttttgaattataacaagtactaccaaattacttctcaaataatttgtaccaattatattacaaccaagagtctgtgagtgtccacttccccatttcttcatcatcactgggtacaaatcaatatttctaatttttgtcaattttataggaaaaagatattttattttcatgtgcaattccctgattactagtaggattgagcatctcatcactgtttattggtaatatttatatcttattttttgcattgtacatttgtactgtgtagtcctttgctcctttgcccagttttttttcatatggattgtccttctaattgacgtgttataagtctttaagtattacagattacctatctagcaaatatttccatttggtcagtcatcatcttctaaattgtctttgtgtaaggtttctttatagcgtccttgtttttgtccatttgggaaattcttccctactttgaggttataaacatgttttattactttttcttttaacttttgttattttatttctttcatttacaaatttaattctttcttgtggcttttgtttttaactctcttgatgggtctgtccactcagtgtataaatattttaggtcttttttttaatatatataatttgaaagcttttctttgtgttaccctgcatgtatctgaaagcctttctcatttctttcttttagtctatgaagtaattatatttactgtctcacttctttgttttccatttaatcttcatatacttataatttggcttacaatcctactgtcatgttaatacaattaatctatgtgcaccacagtaagtaaatttctgaaccaaatggacatttttcagtgctttggggcatttttagtgcctttgggcattaggtagtctccaaagatggctgctttgattttctcccctcgctgttgtgcattcaccactctaaccatcaaaagatggattcgatttaccctcgtctttaatctggtcctctttcttcctagcacagtagtctcaggatagctaaatttcttacatgatggctggctttgcagaataagatggaagctgctaggcctctgaaagtttaggcccagagctggcagagtcattcccaccgtaatctcttgggctaacttcacaagcccaagctagccacgtgacgaggccacatggaggagctctaacatgccagacacgagtgaagcctctttgaccttccaggttagaccagtttctgatcaatgctgctttgtaaatttccctggctaatgctgcatagagccaaagaagcatccaactaactccagttgatcccctaaattgtgagaaataataaaattcagtctctttggtgaatagttctaatgaagtttgacaaatacacggaattgtgtgatactcaccagaacagttccatcatcctccaaaattcttttgtgctgcttgtttgtagtcaaccctcccttacatccaagatttggaaaccactgatctgttttgtgtgctacttttgccttctccagaatgacataaatggaattttacagtttatagctttttgagcctgatttctttcacttacgttaatggatttcagattcattgtgttattgtatcagtactttgttccttttaattggtgagtaggattctgttttttggatttatcacagtttgttttattcaatcaccagctgaaggacatttgggacatttgttttcagtgcttagaaattttgaatatagctgctagaaacgtttatacactggattttgtgtgaacatcactttttatttctcttggataaaatatctaaaatttaattttataagaaattgccaaactgttttccaaagtggctataccttacattcccaccagtagtgaatgagttccaattgcttcacacatcctcatttgagtttggtatggtcattaaagaaaacccctagacattctaataggtatatagtagtatatcattgtggtattaatttgcatttccttagtaattaacgatgttgagcatatttgcatgtgcttacttgccatatatatatatatatcttcttggtgaagtacctgtttagatagtttgctcacttcaaaaaatttgattgttttcttacttttgagtcttgagagttctcaatatattctggattcaagtcctttactaaatatagagtttgcaaacatattctctcagtttgtggtttttcttaacagtgcttttctcttaacagtggcttacacacatcaaatgtttataattttttgaagcccagattgtaatttttttctttcatgaattgtacttttggtataatatctaagaactcttggcatgacccagagttacaaaaattttcttctacgcttacttttaaagttttataggtttacattttaaagtagatctatggtctattttgtgttaatttttatataaggtgtgagatataggttgatatttactttggggcatatggatagtcatttgttccagctcatttgttgaaaaaattgtctttactccattgaatcacttgtgtaccattgtaaaaaaagtcatttgatcttacttatctggttatattcctggactctgtattccatttcattgatgaatgtgtctatctttagttgttactgttttaagccattaaattttgtatttgtttgttatacagcaaaatgtaacaatatgtgacacagtcactgtgaagaactttgaaagggctgaaattttactcctcttgaaagctaacaagttagtctgccacagtttcatgaatcctggtggaagactcaagacttctgggacaaggatgaagaaaaatttactaatcaaaccaatagccatagccaaagtatttgcatttttgtgttggttttctaaaccccaattcccataaggtgatgcaaagagggccaggtaacacctatacacacaggtataatttaatcactgatgcacaagagatacagtaataccactattagtataagtggtaagtgacatagtagttccactgatgtatttcagcctccccttctttctgtggctgattttttttccagaatgaggtcagacattatcttccaagcagcctctggttattttatcttctgagttcctgtagcatcatatgtagtattatgactgagtattttatcttccttattaggcagtgagctcttcgagagtaggctctaactcattttccttatactctaatttgtcaaactattaaaacatttgatgtacttccttttgaagcatctgttgatacagttaccatgccttcactatcttgatgatttcacaagaaatggaacaaatggaatacttgtaataaaaggccctatttttcttgatgatcgtttcccaaagaagttatttctgttctgaaggaagtagctgaaaatacctatgaagtaactgctttcctgaaaatagtacttgttatagtataagtagaaggggccttaacatataatttttaaaaggcttatagctgtgggtaatacgaagtctctaaaatacgtgcatgccagtaatattgagaacaatgccattttattccaggatccaagaagggcattgcataattagcagaacaaattgacaagcagggcacatagtttacatttccatggtaggtaagaatgactattttgattacaatttcatgtgttttgtttacttttttttggtggggggacagagtttcactcctgttgcccaggctggagtgcaatggcatgatgttggctcaccacaacctctgcctcccaggttcaagtggttctcctgcctcagcgtcctgagtagctgggactacaggcaaatgtcaccacgcccaactaattttgtattttactagagacggggtttcttcatgttggtcaggctggtcttgaactcccaacctcaggtcatctgcccacctaggcctcccaaagtgctgggattataggcatgagccactgcgccgagcctcctttgactttcacagccttcaatgtcttcatcctagtacaagaagacacattgaatttttataataaaacatttattaaatttggtgaagtatgagatctgctcaccagtaaaacatcctggtttaactttattattgcttatatttttgtaagtattttaagcataactatttggtttggtttttgaaagttattttctgaatattttggcaaatgaacgtgcaagaacatcatgagttttcttggtgcacagaataataatgctatgggtttatctgggaacctaatagtagagcttgccatagcgtaacatggagctctttgctggagtgtactttctgttgttaattttttagtttcttctaaacaggtttgtaatttgacttttctatttctgagaaaatctgtcatcttaaaagaaacttttagagagttaactgaaagtgaaagcaagttccaaggaacccccaaagaaatatcataactcatcactttatcctaccaccaacttttgctgctgtatgaagcaacctaactcaaccttgtaggaatttatgcatctactatttggaaacatagagttaaatgcccataatatatagctaagagatttgaaagagtttgcctctgaggagggggtgtgggcagtagatgcggagtagggagtgtaaagtatggtttttgttttcagccttctagcactaacttatttgaaatttatgtgcacatagtatttcaataaaaatagaacaagttataaaaagaaaacataaaaagaaatgatcaacccccaaactgggcttagttcttgtattatttcttataggctggaaatagacccacaaaaaggaggctggattgaccctcctttagtggaggtttccccaaagaccctcctggagtgaagggtccccagaggagagtgaaacacaggagttaggtggttgaggcatgagttggccatgagcaaacagtgaaggtgataaaggattacttataccaagagaaccacagatgagagaatcttccaacatccccaaataaaaaaagtcaatacagttgcttcccaatgcagtctactccaccctgctttccaaagtctgatgttccctgtttaaaagggaatctgactaaaaagccagcagttttgggattctttgacatgtggcttcttcaccaaatcctggtatcatctctgtgagaaagatgagagcagaatccacttgcatcatcaaatgttctgggtcttctttgcttgtcaattgaaaaaatagtaaaataaaatgaaagtatctcaaactggactacaatgtcattcttaccaatctttgtaccttgaccaaactttgtcatttgaattagagtgttctatattgggaacaaagttggccagaatgacttaatggcttataatgggagctaggaaagatgggacaaggattgctgcccactatataggtatgacttgctatggtccattccctttggaggcattgagctctggtttgtcatcagtggtatttatctggttatccagataaaccagaggaggtctccatgtagagtaaaaggaaaaaggaatgtagggctttggtggactctcctggattgtagggaggagtcggtaagatagagggcaagtagtggagctaaacatcccctgttagagcaagtgcctctagagagataatatcagcttttccaggcagatggctacaaatgacattctttctgtctctcccagaatcaggatgtctaaagctattattttattttcatttccctccaggatcacttcagtccactaataatcacacaataagaaagatcatgaactaacaattagcctacctaattgtatcacttaaccagtcttatttctttaactgttgcccccaaaacaggagccttctcaactgaattaatgaaggcaagatacattatgtcaactacataatgctgattgattattgagtatctctttatgtcaggaactaggcacttgggatgcatctttgaacaaaacagataacaatattttgctctaattatgcattttttgttttaatcacatttagtgatagcttagaccaagagattaaaaatttcaagtacatctccattccttgtagacctttgtgctctacacacacacacacacacacacacacacacacacacacacacacacacagagacatcttaacatttgaggtgtttaatggtaaatgttgaagtacaaatgtgcttttaactttattgttttctaccactcttatttttttctgctaatggccataaagtacattctttccgaatcttagttatatttgcttctttttttgctaagatatttttaaccactggatagcaagagtcaaataatcatgtacaagtttttaattttatctctctcaaacatgtttttgcttttgaagcattatgtatactgttttatttctttaagtaacaattaaattcataaagttagagtttgtcttatatagtaataaagatggtttccttactccacttcctgtattcaaactattatcaatgatagataatatataggagagaaaattaaaattaagttagaatttttatgaactagaaatgacatagcagtataaagtggtgaaaaggctaaagcccaggatctgctgggagtctagtccctatgaattaaagggtcgggcaagaaaaccaagccagatttgagtttgaattcaggaactacaatagaacttttctattcagcagaggagactgataaaatttactatcagtatctgcctagagctgtggtttaataaagcctgagtctatgaaggtttctggatatagtgttttgaacagatgttgagccaagcttccttctggtgcagcaaattaatttattttatgttcaatagtactgagaggcaggagctcagaccaaccaatatgatatttggttctggactgtaaaactactgggaaaaagagaggtgagcggagacaagagaacatcagcaagaaccttcaactagagaaaaaaaatccaaatttcaaaatacgtggaaaattaaatttaggaaacacatccaataaaatcaataagtgaaaggtcaatgtatcctagatgaatgaaaataaaagcatgatctgaagggtcttttaaaacatgttgaggcccctcaaacatacaaatgaagggataattcacaacaagaaaaaaaaacaaaaacaaaaatgaagaacatatgcatataaaaaatgaaatcttggaaatggaaagcataataattgaattaaaaaactttaatgttatctgacttcgaattgtactacagagctatagtaatcacaacagcatgtaactggcacaaaaacagacacatagaccaatggaagagaactgagaacccagaaacaagcctacacacctacaatgaactcattttcaacaaaggtgccaagaacatacactggggaaaagggagtcccttcaataaatggtgctggaaaaactggatatccatatgcagaagaatgaaactagatcccctatctctctccatgtaaatcatcaaatcaaaaaggactaaagactgaagtctaagaccgcaaactatggaagaattacaagaaaaccttggggaaaatctccaggacattggtctgagaaaaattttttgagcaacaccccacaagcacagccaatcaaagcaaaatggacaagaaggatcacatcaagttaaaaagcttcttcacagcaaaggaaacaaacaacaaagtgaagagacaacccatagaatgagagaaaatatttgtaaactacccatctgaccaagggttaataaccagagtatataaggagctcaaacaactctataggaaaaaatctaaaataatccgatgaaaaaaatgggcaaaagatttgaatagtcatttctcaaaggaggacacacaaatggcaaacaggcatgtgaaaagatgcttaaacatcatgagtcatcagagaaatgcaaatgaaaactatactgacatattatctcacccctgttaaaatggcttatatcctaaagacaggcaataacaaatgctagtgaaaatgtggagaaaagggaacccttgtacactgtaaatgtaaattagtacaactgccatggagaatagtttggaggttcctcaaaaatctaaaaatggagctaccatataatccagcaatcccactctggacatatacccaaaagaaatcaaagaggtatctgtactcctatgtttgttgcagcactgtttataataggtaagatttggaggcaacctaacagtccatcaacagatgactgggtaaagaaaatgtggtacatatacacaatggagtactagtcagccataaaatagaacgaaatccagtcatttgcaacaacatgaatggaactagaaatcattaagttatgtgaaacaagtcaggcagagaaagacaaacatcacaagttcttacttatttgtgggatctaaaaatcaaaacaattgaactcatggacatagagagtagaaggctggttaccaaaggctggaaaaagtagtagggggctggggaagaggtagggatggttaacaggtacaaaaaatgatagaatgaataatacctctatttgatagtataacagggtgactatagtcaataattacttaattgtacattttaaaattacttaaacagtataattagattgtttgtaactcaaagaataaatgcttgaggggatggataccccattctccttgatgtacttattttacattgcatgcctgtatcagaacatctcacttatcccataaatatatacacctactatgtaactacaataattaaaaatgtaaaaaatctttagattgggaaaacaaactataatgtctactgatggatgtcctacatactggaaatgtagtgaaaatggtgatggtgatgtagaatgaggaactggtgcttgtgaagcaggttcactgtgcactgcttaccacttcagaatcctgggctgcacttttactatgtacctgagtcttgtgagataaaaaaactctctcacacacaaattgcatagttttgttacttatagatgggcagaaagggacaacagaagcctacgagttatgatgagccagtccccgggggctcaggaaatctgctcagagcagatggagtctcctctgagagtgccttattgctcccagggtaaaaaacccagggtgggctgctttccagggtcccttgtaccacagctgagggaccctggaaaccagcccaccctcaatttttcaccgtgggaacaataagacacgctggctgaagcgatgaaggatatactgtttctaggggcaacagggacagagtctgtgctcttctggccacctcctccttatctcaggatgttgcatgtccagcacattctagttaattctgcagaactacaagtaagaaatgggggagaactgggttggttcaacaccacccatggaactgtcctgcagtaatgtcatgtatggaaaattatacgggaatatgaaaaatcagtagaaagaaagaaaaaaagatattattagcacatagaataaactctagacaggtcaaaatcaaatagaaaattagtaaattggaagataatatttagaaatgggctcagaatgtagctgagataaacaaaaagtgatttaaaaatatgaaggattcattaaaagaaatgaaggatagctgcaaagactgcaacatacatacttatagacactctatgaaaccctacaagttccaggagatgcaaataaaggaaataaagaagcaatattcaaagagatcatttctgaggaattttcaaagtttgagaaagatgtgacttcttagattgaaagtgtaccccaaaaagcatgtaggaccgttaaaggtaactccatacctagtcacaaatttgtgaaactagagaacatgaagaataaagagaaaagtcttaaaatcttccagaaagaaaaagagaaaagattacctaaaaggcctgacaatgagaatgtgagcagacttctcactactaatagtatgtgccagaagatatttgttaattatcttcaaattgctgcggtaaaattactgtcgactagaattttatatctagctaacctatcacaagagtgagggtaaaatatagacgttcacagacatagaaataagagaacttaactaaagcatattccgtaaagagaggaggaacgaaattaaaaaaaatgataaacacaggaagtggcaaaatatgttgatgaattttactaacttaaaaagaagattgagggaggctggccaggattgccaactagaagcagctagtgtgctctgctctcagaaagagaaatagaaggggcaagtaaatacagcaccttcaattgaaacatccaggtacacacattgggactcatcaggaaaacagctaaacccattgggaacagagagaagcaaggcaggattactgcccacctgagagtgacagggagccagggcagcctccctctttcagggaagtggtgagtgagtgagtgaccccagggacccatgcttctcccatggatctttgcaacccttgggtcaagagagctccttgtgaacctctccaccagggacttcagtctgacacacagagctacgtgaagtcttggcagagcagctgctcaggtacatatggaacctggggagacttagatacctgggcatccaagcaaaagtggttgcaagtccagcaaatcagaaggttagacccctatacatacccataagaaaagggatgaatccaggggcctgagaagtgacagtttgcaggccctgcttctacagcacttggcaggacaagacccactggcttggatcctatttctcttcactggccagaatctattgactgaggtctgcaaccacccccaccagtgttttccaggagacatcagttccaaacctccctggaatggagcttccagagggaggggcaggccacaatctttgctgttttgcagccttagccattgttgccttcaggctttggagagctcaaagtgactgggggctgaagcagacccctagtacagcacagctgccctatgaaaaagtggccaggctgcttttatgcagtaggtccctgatcctgttcttcctcactgggtgggacctcctgaccagggtctcctgccatctctgccagtgtgtttgggctggaaacccatccatacctccctgggatggagcttccagagaaaggggcaggctgacatctttgctgctttgcagacttcactgttgataccttcaggtaataatagaaaatccaaggtgactagggactggagcggaaccccagcatactgcagcagccatatgggaaaatggccagactgttttccgtacatgtcctggtgcttacttctcttcactgggcagagctgcttgacctgagacaccaccacagccaccctgccattgcctgaccacttcaatcagaggcagcccagcatttctgtaaggagaaaatcctaaagtcaacccacagcccctctgccactgcagttgcagtggtactgccctaatagcctacaggctggggaaagaataaaggcctagtcactcactccctggtacctccagcacaccacagccaccatatggagaggagtccagcccctctgccctaggaatcttccccctacactcttcaccagtcagggcctccacctcataactgcagaaacatcccacccatggtggagtatacccactagtagtggcttggagttttcttgtgaagaggcttccagaggcatcccacagccattctgccactgccaaagcagcagttctatccctgctgcccttggtctggggaagagacaaagagcctgaggactatacctcaggttacagaacaccacatccaccatatggggagaccagtatctcctcccagtgagcccttgaccccctactccccaacaacagagttctaagctcataccactagtgctgctgtcccaccccactggctgaacactcccagtaacagcagctctgcatttcttggaggtggggccctcagaggcaacccaaagtccccctgccatggcctctgcagtggtactaccccttctacccttggactaacaaaggagcaaaagccctaagtaccttatccatacttcaacaagcagcagttgacccaaggagaggaggccagttcatcttgcatgagtcccacccaccccactgctcatcactaagcagggaacccccagcttgggtccacagcacagacccctaacttgggctgattacactgagagatagctgacctgtatctctctagagcaaagcccccaggagacaagtaaaagaccctcatcacaaccactgtgaaggtcctgtcctctgctgcctccaagttggggaggaaacattaaccttgagattaccccagaactgtgttgggcagcctgggaatgccaagctgtgatctacagccagcactgaagtgggagaggagctcacactttcagagcatagagaggcagcatggctacagctgtgaggaaatataggagagccacaagactgagcaagagactcttactgaccattatgcctaagtgccacccactggatcacatcccaaaacttcaacacctaaagtatctcaccaactttgtgaaaccaaagacaagaagctacaaataattaccctgcacaaagccttggtcctgtgaaaacatccagaaaagaagtcaagaagtctattgattttactcaatcttcactgcagttaaaggaacacccacatgcagagatgagaaggaaccaacacaagaactctggtaactcaaaaggccagtgtcttatgtcctccaaatgactgcactagttctcaaagaagggttcttaaccaactcattggctgaaatggcagacatagatggataggaatgaagatcattgaaattcaggagaacagcaaaagccaatccaaggaaactaagaatcaccataaaatgatacctgtgctgacagatgaaatagccagtataagaaagtatctaactggtctgatagagctgaaagagacactacaataatttcataatgcaatcacaagtattaacagcagaatagatgaagctgagaacaggatcctggaacttgaagactagctctctgaagtaagatagtgagatgaaaataaacaagaatgaagaggaatgaacaaaaactttcagaaatgtgggattatataaagaggccaaatctacaaatcactggtatccttgacagggatgatgagacagcaaacaacttggaaaatatatttcaggatatcatccatgtaaacttccccaacctcactaaaggggccaaaaataaaattcaggaaacacagagaacccctgcaggattctacaccagaaggtcatccccaagacacataatcatcagatttttcaaagttgaagtgaaagaatgttaaaggcagctacagagaaagggcagttcacctacaaaggaaaccacatcagactaacagttgacctctcagtggaaaccttacaagacagaagagattgggggcctatattcaacattcttaaagaaaaaaatgttcaaccaagaatgtcatattcagccaaactaagctttctcggcgaaggagaaataagatccttttcagatgagcaagtgctgagggagttcattaccatagagttttgtattgttactagccaatacaaaaacacacttaagtacacagaccagtgacactataaagcaaccacacaaacaaaccagcataataaccagctaacaacacaattacaatatcaaatctatacatattaatactaaccttgaatgtaaatgggctaaatgccccatttaaaaggcaaaaaatagcaatgtggataaaaaagcgagacctgatagtatgctatcttcaagagatccatctcacatgcagttacacccataggctcaaaataaagggatgaaggaaaatctactgagcaaatggaagtctgaaaaaagcaggggctgcaatcctgattttagacaaaacagactttaaaccattaaagataaacattgacaaagaagggcattatattaatataatggtaaagagttaagttcaacaagaatacctaactatcctaaaaatatatcctgtgttcccaacacaggagcaccaagattcatacagcaagttcttagagacctccaaaaagacatagtcttgcacacaataaaagcggaagacttcagcactccactgacagtattagaccaatcattgaggcagaaatttaacgaagattttcaagaactaaactcagcactggatcaatggacctgatagacacctacagaactctccaccccaaaacaacagaatataccttcttattgctacatggcacatacactaaaatcaactacataaacagacataaaagaattctcagcaaatacaaatggactgaaatcataacaaccactcagttggactgcagtacattaagattagaaatccagagtaagaaaattactcaaaaccacaaaattacatggaaattgaataacctgctcctgaatgacttttgggttaatcatgaaattaaaacagaaatcaaaaagttatttgaaactaataagacccacaatacaacataccagaatctctaggacacagctaaggtaatgttaagagggaaatttattgcactaaatgcccacaacagaaagtaagaaagatagcaaattaacaacctaacatcacattgaaaagaactagcaaagcaagagcaaaccaactacaaagctagcagaaggcaagaaataaccaaaattggagctgaaataaccaattgaaggcaagaaataaccaaaattggaaactgagcagaaaaccattcaaaagatcaacaaatccaggagttggttttttggaaaaaagaaaaaagataaataggccactatttatcttattattgtaataagactaataaagaagaaaagagagaggatccagataaacacaattggaaatgacaaagggaatattaacactgactccacataaatacaaatgaccatcagagactgctacaaacacgtttatgcacacaaactagaaaacccagaggagaaggataaattcctgggcacatacactctctcaagactgaactagaagaaattaaaaccctgaacagaccaatgatgatattcaaattgaatcagtaataaataggctaccaaccataaaaaacccaggaccagatgaattcacagccaaattctaccagatgtacaaagaagagctggtaccgttcctactgaaattattccaaaaaattgaggggagggactcctcaattcattctatgaggccagcatcatcctgataccaaaacctgtcaaagacacaacaaaaaataaaacttcagaccaatatccttgacaaatattgtttgtcaaaaaaatactggcaaatcaaatgcagaagcacatcaaaaagctaattcaccatgtccaagtaggctctatccctgggatgcaatgttggttcaacatatgcaaatcaccaaacgtggttcatcacataaacagaactaaagacaaaaatcaaatgattatctcaatagatgcagaaaaggctttctataaaattcaatatctcttcatgttaaaaaccctcaataaattaggcagtggaggaacagacctcaacataataaaagccatttatgacaaacccacagccaaaatcatagtgaatgagcaaaagctggaagcattccctttgaaaacctgcactagacaaggatgctctcttacttttcctatttaacatagtattggaagtcctggccagaacaatcagcaagagaaagaaataaaggacatccatataggaagagaggaagtcaaattaccattgtttgcagactacatgattttatacctagaaaacccaatagtcttggcccaaaagcttattaagataataaacaacttcagcaaagtttcaggatacaaaatcaatgtaccaaaatcactaacagtcctatacatcagcagcagccaagtgaagagccaagtcaggaacacaatcccattcacaatagccacaaaaggaataaataacctgggaatacagctatcccgaaaggtgaaagatgtctgcaatgagaagtacaaaacaattctgaaagaaatcagagatgacacaaacaaatgaaaaaacattccatgttcataaatcagaagaatcagtataattaaaatgaccataccacccaatttacagattcaatgttaattgtaccaaacttttaaacacattcttcatagaactagaaaaaattattttaaaattcatatggaaccaaaaaggagcccaaatagccaagacaatcctaagcaaaaagagcaaaactgaatgcttcatgctaccagatttcaaactatactacagggctagagtaatcaaaacagcatggtactggtacaaaaacatacacatagagctatagaacagaatagagaatccaaaaataaggtcaaacacctacaaccatctgatctttgacaaagtcagcagaaacaagcagtgtggaaaggaatctctgttcaataaatggtgctgggataactggctagccacatgcagaagattgaaactggaccccttccttacaccatatacaaaaattaactcaagatggatcaaaggcctaaatgtaaaacccagaaatatagaaaccttggaagacaacctggacaatacgattctggacacaggaactggcaaatatttcatgataaagatgccaaaagcaatctcaacataagggaggagaccaccccacatattgtcttatgcccaatttctgcctccaaagaaagaagtaaaaactaaaaggcagaaatgacatccacaggcagacagcccagcgccccaccctgggcctggttaaagatcaacccctgacctaactggttatgttatctatagattccagacattgtatggaaaagcactgtgaaaatccctgtcgtgttctgttctgatctgattacttgtgcatgcagcccccagtcacgtaccccctgcttgctcaactgatcacaaccctctcacatggacccccttagagttgtaagcccttaaaaggaacaggaatttctcacttggagtgcttggtttttggagatgtgagtcttgccaaagctcccggctgaatacagcccttccttctttaactcggtgtctgaggggttttgtctgtggcttgtcctgctacatttcttggttccctgaccaggaagtgaggtaattaatggatggatggttgaggcagccccttaggcagcttaggcctgccctgtggagcatccctgcaggggactctggcctgcttgagcaacatggatcctgagagcactcctgggtaggcatttgacctggtagaatgccttgtcagagtggtgcatggcaggcctctgtggaggatcaacacagtggctgaacactgggaaggaactggtacttggggtccagatatctgaaacttggtaagaccagtctttggaactagcccactccatttgagtggaagcgtggcctgatcacccacgacatgcctgtactggcactttggtttttaacttgacttggattgcttgatactttggttttggttttgacctggcttggatttcttggtactctgattttggttttgattctggtttggtgtaaactgtaaaagtgtgtgtgtgtgcctttttacccgttctttgttttgtggtgtacgtgtggtttgagcatggtgttttgtctcaaggaagcatgggtcaggcacaaagtaagcccgccccaccaggaactatgttgaaaaatttcaagaaaggatttaagggagactatggagtactgtgacaccaggaaaacttaaaactttgtgtaagattagaggtgcgttggccatcggaatgaagcctggacaggtcccttgtttcaaaggtatggcacaaggtaacccataagccagggcacccagaccagttcctgtacatagagatttggttacagctggttttagacaccccccaccacagtggttgagagaatagcagcataagttgctggcagaggaaaggaaagaccagcagagagagacagagagagagagagagagaggaaagagacagagagagaaagaggcaaaaagagagaggaaaagacagaggaagagacagagagacaaagagggagtcaaggagagagagagagaaagagacaggcagagagagagaggaagagacagaggcaaaagggaagtcaaagaaacaaagtcaaagacagaaagaaacagagaaagagagtaatatacaagtagttaagaaaaaataaaacagtgtaccctattcctttaaaagccagggtaaatttaaaacctataattgaaggtcttctccatgacactacaacacgacaataccaccttgttgtaagtgtaaacaagggcatagcccgaaagcactgaggccactgacaacctgtagcctccctatcaaaaatccttaacccagtaacctgtggatggcccagatgcattcaatctgtagcggcaactgctttgctaacagaagaaagtagaaaaataacttttagaggaaacctcattgtgagcacatctcaccaggtcagaagtatcctaagtaaaaaaaaaaaaaaaaaaaaaaaaaggtgatttaacattaaccactgaaaattcccttaactcagaaggtttcctaacaggggatctaaatcttaattaccatacaaaggtctgaccagacctaggaggaactcccttcaggaaaggaggatagatgtttccttctgggtaattgaagggagaaaaaaaaaaaaaagccatctataccggttctaagttaatttggactaaacaagatcttattaatagcaaaggataattgaaatcccaaacttacaaggttttcaacaaaagtaaagtttgctaaaagttaacagtgtaacatgtattatagtaacttctaatcttgtggccttagacagtctagtccacagacataaaggaagttcactttggaaaagaatggttatcatcttccagaaaaaaaagtgaaataaaggggggagggcagaatttatgtaaaaagaatgttatatggtaaattattgtcctgaaataacttaactggttgtttaaagaaaaaaatgtttgtaataagtcagaaaattgaggcatgtcaaagaattgtctgtgaaaatcatgaaaaaatgttataaaaaagaatttatgccagaaatgcataatttaaaagtaataaggcctcctgagtactattgaagaaacagtttatgtgcaaggtgtataaggaaagtaaaatatacctttggtaaaaggattataaggaggcatgagaaagcaaatttttacatacactaaaatatcaaaaacatttttgttttgaaggtttaagcaagttttaaaatgtcaattgtaaagaaaattctgtgtgtaaacatattagctaaagttaaaggcgtatcatccagtttttctttgaactggacattaaaggaaaaacacaaagggtttttcttaaagcactaacctgctctttaacaaagattataaaaggttaaaaagagtctataaaaatcttaccttatggtctgacattaaaaattaaataaatatatctacaacgttttattaaaactaagtttaacattagtaacacactaatataaaggtgaaatttagcttatctggtataaaattatacaggaagcattgtcaaatataaaatggtgtttggcttctttgatctaaaaactaataaaaataggtgctgaatgaaatttctcagtagaaaggcactaaggactataaaataaagtccactgctgatgtccccacatttaaaacaaaaggtcaatttcttaaaaattatatacttggtttatcttccactttcctttccctcaaaactaaaagtctttaaacacatgtaccacccctagaatttccagtaaaccagcaccagcctgaagatcacattctcatcaaaagttgaaaagaagggaaactcgagccagcctaggaaggaccctaccttgtgctgctaaccaccgagaatgctgttcgtacagtgaaaaaaggatggactcatcacacccgagtcaagaaagcgccaccccctccagagtggtgggccatagccccaggggaaaaccctaccaaacgaaagctaagaaaaatttaaccctttcatctattctattactctttcttttttccttgttctgttgctgaccatctagttattaacataaccaagtcaatttcacctcaaactgttgcatttaatgcttgccttgttataccctgtggggacttgccaagtcaaagacagctctctacttcagaaaagtacctctgtccctcctgactctcctcagactgggcattagtaaattaggaccatttaatctggggaaatttcgataaagactccagtgtcaaccaggagtctagccccccagtgtggagcttttatgctgtagttggtctaacgttctgtggaccactaaagagcaaggatggtctgccccaacagatttttgtaatttcctaaaattatacattcattttactagaggatcatagaagttaaagacttaaaacaaactttggcaattaagacaggataccaaggtccaaatgcctggttgaaatggatcaactattccatccacatgttaaacaaaagcaattgttatgcttgtgcacatggcaggccagaggcccagattgtcccctttccactaaggtggtactccagtcgaccaggcgtgggctgcatggtagctcttttctaggattctacggcctggagtaataagtcatgccaagctctttctgctacatcccaaagtccggcaccctgtgggtcagcccctgaggcccatccagcctccgtctcccaacactaaggtcactttgtgtctctcacaacagggaggaaatttagcgttccttggagacctgaagggatgcagaaaccttaagaattttcaagagcttatcaatcagtcagtccttgttcatccccgagcaggtgtgtggtggtattgtggtggacctttactgggcactctgctgaataactggagtggcacttgtactttagttcaattggctatccctttcaccctggcatttcatcaaccggagggaggaaaaataagacattgtaaagtgagagaactcctttatgggtctttcgactctcacgtctatttagatgcaattggagtctcacagggaataccagatcaatttaaagctgaaataaaaaagctgcaggattttaagtcaacattttggtgggtaacagttaataaaaatgtagattggataaactacatctgttacaaccaacagcaacgagcttttcatgagttaaaagaaaaactcatgttggcctcagccctggggctacctgacctgacaaaagcctttacattctatgcatcagaaagagaaaaaatggcagttggagttttaacccagactgtggggccctggccaaggccagtggcctatctcttaaaacaactagatggggtttccaaaggctggccctcatatctaagggccctggtagcaatggccctgttagcacaagcagcagataaactaacccttgggcaaaacctgaatataaaggccccccatgctgtggtaactttgatgaataccaaaggacatcattggctaacaaatgctagattaaccaagtaccaaagctagctatgtgaaaatccccacataaccatcaaagttggcaacaccctaaaccctgccaccttgttcccagtatcagagagctcagttgaacatgactgtgtagaggtattagactcagtttattctagtgggcccaacctccaagaccatcctagaacatcagtagactgtgagctgtacatggacaggaacagctttgccaacccctgcaaagtgactctgaaggaaacgacaaagccctgctccattcacaccctgaagctgactggcccacacatggccgaagcatgagaaaactcattgtgggactcattttccttaaaatttggacttacagagttaggacttcaactgaccttcctcagactgaggactgttcccagtgtatacatcaagtcactgaggtaggacaaaaagttgctacagtcctattattttatggttattataagtgtaccaggactctaaaaataacttgtttgtataatgctgttctatacaaggtatgtagcccaggaaatgaccaacccgatgcatgttatgacccatctgagcctcccatgaccacagttttttggttttttgaagtaagattaaggactgagaactgatgggggctcataaatgatgtgagttagccaaaacagaagaaaaaggggtgcccagacaagtcaccttgaaatttgatgcctgtgctatcattaatagtaataagttagcaataggatgtggttctcttaatcagaaaagaggctatatggcagaaaatcagtacatttgtcatgaattaggactgtgtggaaatgaatgtggatactggtcttgtgtcatttaggctacttggataaaaaatgaaaagtatcccatccactttcagaaaaggaaaagtggccgttcctgtaccggttgtcagtgtaaccccttagaactagtaataaccaacccccttaatcctcgctggaaaagaagggagtgtgtaaccctaggaatcaatggggctggactagatcctctagtaaatattgtggtttaaggagaagtttataaacgctctcctgagccaatatttcaaaccttgtatgataaactgaatgtgccagtaccaaaaattccaggaaaaacaagaaatttgtttttgcaattagccaagcatgtagtctagtctctcaatgtcacttcatgttatatatgtggaggaactgtataggagatcaatggccatgggaagcccaagaattagtacctacagacccagtttctgctgaattcctgactcaaaagaattaccctgataacttctaggtcctaaaagtctcaatcattagacaatactgtatagcaagactagggaaggacttcacccttcctgtgggaagactcagctgccttgggcaaaaattgtataatagtattacaaaaacagccaccgagtggagttcaaagcacattaagaaaaattcatttggtaaattcccaaagttgcaaaccgtgtggacccacctggagtcccaccagtactggacagcccccactggattatacaggatatgtggacatagagcttatgccaaattacccaaccagtgggcaggtagttgtgttattggcactattaaaccatctttcttcctactgcccataaagacaggcaaactcctgggcttccctgtctatgcttcctgcgaaaaaagaagcatagctataggaaattggaaagatgatgaatggccccctaagagaatcatacaatattatgggcctgctacttaggcacaagatggcttatggggataccggatcccatttacatgctcaaccaaatcatacggttacaagctgtcttagaaataatcactaataagaatagcagagccttgactattctggcccggcaagaaactcagatgagaaatgctatctatcaaaatagattggctcttgactacttgctagcagctgaaggaggggtctgtgggaaatttaaccttactaattgctgtctacacataggtggtctagggcaagtagttgaagacatagttagagatatgacaaaactggcacatgtgcccgtgcaaatgtggcatggatttgatcctggggctatgtttggaaaatggttcccagtgctaggaggatttaaaactcttataataggagttataatggtaatagaaacctgcttactgctcccttgtttgctacctgtactttttcaaatgataaaaaacttcatcgctaccttagttcaccaaaatccttcagcacaggtatactatattaatcactgttgatgtgtcttgcaagaagacatgggtagtgagaactcacactaataagtgaaattctcaaagcaggggaataagggaggagaccacccctcatattgtcttatacccaatttctgcctccaaagaaagaataagtcaaaactaaaaggcagaaatgaaatccacaggcagacagcctggcgccacactctgggcctgtttaaagatcgacccctgacctaaccagttatgttatctatagattccagacattgtatggaaaagcattgtgaaaaatccctgtcctgttctgttccattctgattactggtgcatgcagcccccagtcacataccccctgcttgctcaatcgaccacaaccctctcatgtggacttccttagagttgtaagcccttaaaagggacaggaattgttcactcagagagcttggtttttggagatgtgagtcttgctgaagctcctgagccacataaagcccttctttctttaacttggtatctgaggggttttgtctgcagcttgtcctgctagaaacaaaagcaaaaattgacaaatgagatctaagtaaacttaagagctcagcacaacaaaggaaactatcaaccgagtaaacagacaacctacagaatggaaaaaaattttcgcaaactatccatctgacaaaggtctaatatccaacatctataaggaacttaaacaaatttacaaggaaaacactccataaaaaagtgggcaaaggacatgaacagacactttccaaaagaagacatacatgtggccaagagtcatatgaaataaatctcaatatcactgattattagagaaatgcaaatcaaaaccacagtgaggtaccagctcataccagtcagaatggctattattaaaaagtcaaaaaataacagatgttggcaagcttgaggagaaaaggaaacacttatacactgttggtgggagtgcaaattactcgaatcattgtggaaagcagtatggtgagtcttcaaggagctaaaagcagaactaccatttgacccagcaatcccattactgggtgatatggtttggctgtttcttcacccagatctcatcttgaatttccatgtgttgtgagagggacccagtaggaggtaattgaatcatgggggcaggcatttcctgtgctgttctcatgatagcaaatatgtctcataagatccaatggttttaaaaagggaagtttccccacacaagctccctcttctcttgtctgccaccatgtaagacatgccttccaccttctaccatgattatgagcctccccaggcacatggaactgtaagtccattaaacctctttcttttgtaaattgcccagtttctggtatgtctttatcagcagtgggaaagcagactaatagagtaaattggtaccagtagagtggggcactgctggaaagatacccagaaagttgctgggagcaatttgttataggaagaggttagaacggtttggagggctcagaagaagacaagaaaatgtgggaaagtttgaaactccttagagacttgttgaatggctctgaccaaaatgctgataatgatatggacaataaaatccaggctgaggtggtctcagatggagatgaggaacatgttgagaattggagcaaaagtgactcttgttatgttttagcaaagagctggtggcatttttcccctgtcctaaagatttgaactttcaacttgagagacatgatttagggtatctggcgaagtaatttctaagcagcaaagcattcaagaggtgacttggggctgttaaaggtattcagttttaaaatggaaacagagcataaagttcagaacatttgcagtctgacaatgtgatagaaaagaaaaatcccattttctgaggagaaattcaagccggttgcaggaatttgcataagcaatgagaagttgaatgttaatccccaagacaatgggaaaaacgtctccagggcatgtcagaagtcatcacagcagtactcccatcacagcctggagacctaggaggaaaaagtggtttcatgggctgggcccagggtccacatgctgtgtgcagtctagggacttggtgccctgtgtcccagctgctccagccatggctgaaaggggccaacatagagctcagtccatggcttcagaggatgtaaggcccaagctttggcagcttccatgtagtgttgagactgtgagggtgcagatgtcaagaattgaggtttgggaacctcctcctagatttcagaagatgtatggaaatgcctggatgcccaggcagaagtttgctgcaggggaagggccctcatggaaaacttctgtgaaggtgatttggaagggaaatgtcagagccctcatacagtgtccctaatggggcagtgcctagtggaggtgtgagaagagggctaccattctccagaacttagaatggtagatctactgacagcttgcactgcgcacctggaaaagctacagacactcaatgccagcctgtgaaagcaactgggagggaggctgtaccctgcaaagccacaggggtggagctgcccaagaccatgggaacccatctcttgcatcagcatgacccaggatgagagacatgaagtcaaaagagatcattttggagctttaagatttgacggccctgctggattttggacttacatggggcctgtagccctgttgttttggccaatttttcccatttggaatagctgtatttacacaattcctgtaccccccactgtatctaggaagtaactaacttgtttttgattttacaggctcataggtggaagggactttccttgtttcagatgagactttggactgtggacttttgagtgaattctgaaatgagttaagactttgggtgactgttgggaaggcatgactggttttgaaatgtgaagacatgagatttgggagggggccaggggtgaaatgatatggtttggctgtgtccccacccaaatctagtcttgaatttccacatgttgtgagagggacctggtaggaagtaactgaatcataggggcaggcctttcccatgctgttctcatgatagcaaataagtctcatgagatctgatggttgtgaaaaggggagttgccccacacaagctctctctcctcttgtccgccaccatgtgagacatgccttctgccttccaccattattgtgaggtgttgccagccacatggaactgtaagtctattacacctctttcttttctaaattgccctgtctcaggtatgtctttatcagcagcatgaaaactgactaatacactgggtatatacccagaggaatataaagcattctaccataaagacacatgcatgtgaatgttcattgcagcactatccacagtagcaaagacatgaaatcaatctaaataaccatcagtggtatactggataaagaaaatatggtacatatacaccatggaatatgatacagccattgaaaaagaatgagatcatattctttgcaggaacatgaatggagctagaggccatcatccatagcaaactaacacaggaacagaaaaccaaatactgcatgttctttcttataagtgggtgctaaatgataggaacacatggacacaaagaggggagcaactgacagcaggttctacttaagggtggagggtaggagacaggagaggatcagaaaaaaataatatattgggtccaaggcttagtaactgggtgatggaataatctgtacaacaaacccctgtgacacagtttacctatgtgacaaatctgcatatgtaccccagaacctaaaataaaagttaaaacaaaagattataaaaataactcagcttttagaatgtgtttgtttgtaagagataacaaaaccctagcaaaaaacaataaggaatacagggtagtagtaatattcaaagtgtagttgaagcatgttaaagattttgtttgctttggaggaaacaaaatgtctccaataacgccctcagattttgttagaaaaacttacggttaactatgcaccagttaggttctatagattagctagaatctcctttaccatgatacctatatatctgtgcgtaaattccacttcctgaattcagaaatatacttggatgaggctttcattggtgaggttgaaggtgacaagtccgggctgtggttgtgtctgagtgtgctgtgctattctataccctgccatattacacagttcatgactccagattgtcatccacctgtaccttgtcaacccgcatccacagatcctgactggcatatgagcatatggacaaggagaaggacatttatgctgactgaatttctgatatgtcccttaattatgtagacattattatccatacaggtgaagctcttaaagtttgaactgctatctcttctagagaatgttactaatattttttctgtaaattctatttttgatggctttcttccctatcctttagagcagtaaaccctgtttgatctacccaaatgatatttggtctgtcatttcttccaatatgatcttacaaattattatactataggttccaactagtagaggaaatttataaccctcaaacatgaagagaaaaacaatgtacatgtgtatgtgtgcatgtgcatgtatgcgtgtgggtgtgcttgcgggaagaagtatagaaaatgttatcaattcaacagaaagcaggaataaggatggacaaagtatgagatagaaaataccaaatcagagtagaaatgagccctgatacatagaaaatttctctaaaaagtcactcataaaaaagagattatcactttggacacaaagaaaaaacacattaatgttgcttttacaagagactgatttaaaacaaaataacacaggaatattgacaatagagtgatgaaaagagatgcaccagatatctgttgtcctaaaagaaacagtacaaaagtaacataataatcatgaatttgtatgtgctagcaataaagctttgaaatatggaaagtaaacatggatagaattttagggagaaattgacaaatgcacattcaaataaaaaatattaataaggttatgcaagtgttaaacaacttgattaataagcttggtcttaacaagtgttaacaaacttggtttattatagaaatttatcctgcaaaataaatatgcgtttatttttcaggtacatagaattaattacttatttttatcctacagaaactctgtaccatggagggtttagcagtgctgtaccgctactaccactcttcctactaaaattattaccactattattactgttactagtttattactaatagcctacactaatttagcatttaaatgtacatgaaacatgcctaatatgcattttctcatttaaaaaccagaacaatattttgaatatacatgctttctcattcaaagtgcaaagaatatcagtagtgacaaaacattttctgttatttaggttaagagtattgtatgtgaggtaatgcatatgcttattagctagatttagtcatttcacagtgtatatatacttcataacatcatattatacaatggtaaatacatacaattttatctgttgatgtaaaaaaaaatttaagaagcatattccatcactgttaatggataacctatcagacgtaatgagaagaatcttttaaaaacctacctgccatgaaagcatcactatagaaaacatatcactactatcagaatggcagagaaactggatcaattatacaatgctggtgggaatgtaaaatggcacagccattctggaaaacagcttggcagtctctttaaaagaaaactaaatatgcagtaaatatgcattattgggcatttatcatagggaaatgagaacttatgttcatgcaaaatcctgttcatgaatattcttagcagcttattcgtaatatcaaaaactggaagcaactcaaatgtccttcaacgggtgaatggttaaacaaactgtgttccatccataccattcaatactacttagcaatatgaaggaatgaactattgatacaagcaacaatttggatgtatcttaaggtaattaggccgaacgagaaaagccaatcttaaaatgttacatactattggccaggcatggtggctcatgcctgtaaacccagcactttaggaggccgaggtgggcagatcacaaggtcaggagttcgagaccagcctggccaaaatagtgaaaccctatctctactaaaactacaaaaaattagctgggcgtggtggagagcgccttaatcccagctactcgggaggctgaggcaggagaatcacttgaacccaggagtcggaggttgcagtgagccgagatcacgccattgcactccagcccaggtgacagtccaagactctatctaaaaaaagaaaaaaagttacatactatcagattctgtttatattgtgttcttgaaataaaattgtagagatcgatggaacacaaattagtagttgccaggtgttagggatgggaggttggagttgagtgggtgttgccataaagaggtagtggttatgggagccttgcagtgataaatcagttctgtatcttcagggtgatggttacacagatctacagcagatcacacacatacacacacgcacacacacacacacacacacacgtacttacaaaactagtgaaatctgataaactctgtggattgtaccgatgtaattttcttggttttgatattgtacattagttatgcaaaaatgttatcattgggagaaactggatgaagggtaaaaggcacctccctgtacatggtttttttttttttgaatttcctgtgaatctacaattatttaaaaactaaaagttaaaaaagtgatctattcaatatttgtcttttacagttgattatcataatttttgtgttaaaaattgtgaaagccctgaatcaatatttaataagataagtttctgtgaatgtggatggtaggctctttacattccagggaacatagttataaatgtttttccttttcttgacaaaggaagaggtttttggtttgtttgtttagacaaacccacatgtttttagaaaaaagtaatttatttattttattttattttattttatttttgttgttccagttatatcttttttttattattatactttaagttcaagggtacatgtgcacagcgtgctggtttcttacatatgtatacatgtgccatgttggtgtgctgcacccattaactcatcatttacattaggtatatctcctaatgctatcccttccctctccccacaccccacaacaggccctggtgtgtgatgttctccttcctgtgtccaagtgttctcattcttcaattcccacctatgagcaagaacatgtggtgtttggttttttgtccttgtgatagtttgctgagaatgatggtttctagcttcatccgtgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttataatcctttgggtatatacccagtaatgggatggctgggtcaaatggtatttctagttctagatccctgaggaatcaccacattgacttccacaatggttgaaatagtttacagtcccaccaacagtggaaaagtgttcccatttctccacatcctctccagcacctattgtttcccgactttttaatgatcaccattctaactggtgtgagatggtatctcattgtggttttgatttgcatttctctgatggccagtgatgatgagcattttttcgtgtgtctgttggctgcataaatgtcttcttttgagaagtgtctgttcatatccttcacccacttgttgatggggtttgtttttttcttataagtttgtttgagttctttgtagattctggatattagccctttgtcagatgagtagattgcaaaaattttctcccattctgtaagttgcctgttcactctgatggtagtttcttttgctgtgcagaagctctttagtttaactagatcccgtttgtcaattttggcttttgttgccattgctattggtgttttagtcacgaagtccttggccatgcctatgtcctctatgtcctgaatggtattgcctaggttttcttctagggtttttatggttttaggtctaagatttagggctttaatccatcttgaattaatttctgtataaggtgtaaggaaaggatccagtttcagctttctacatatggctaaccggttttcccagcatcatttattaaatagggaatcctttccccatttcttgtttttgtcaggtttgtcaaagatcacatggttgtagatgtgtggtattatttctgagggctctgttctgttccattggtctatatctctgttttggtagcagtaccatgctgttttggttactgtagccttgtagtatagtttgaagtcaggtagcatgatgcctccagctttgttcttttggcttaggattgtcttggcaatgtgggctcttttttggttccatatgaagttgacagtagttttttccaattctgtgaagaaagttattggtagcttgatggggatggcattgaatctataaattaccttgggcagtatggccattttcatgatattgattcttcttatccatgagcatggaatgtttttccatttgtttgtgtccttttttatttcattgagcagtggtttgtcgttctccttgaagaagtccgtcacatcccttgtaagttgaattcctaggtattttattctctttgaagcaattgtgaatgggagttcactcatgatttggctgtctgtttgtctgtttttggtttataagaatgcttgtgatttttgcacattgattttgtatcctgagactttgctgaagttgcttatcagctgaaggagattttggactgagacgatggggatttctaaatatacaatcatgtcatctgcaaacagggacaatttgacttcctcttttcctaattgaataccctttatttctttctcctgcttaattgccctggccagaacttccaacactatgttgaataggagtagtgaaggagggcatccctgtcttgtgtcagtttccaaagggaatgcttccagtttttgcccattcagtatgatattggctgtgggtttgtcataaatagctctcattattttgagatacatcccatcgatacctaatgtattgagagtttttagcatgaagggttgttgaattttgtcaaaggccttttctgcatctattgagatagtcatgtggtttttgtctttggttctgtttatatgctggattatgtgtattgatttgtgtatgttgaaccagccttgcatccaagggatgaagcccacttgatcatggtggacaagatttttgatgtgctgctgtatttggtttgccagtattttattcaggatttttgcattgatgttcatcagggatattggtctaaaattctctttttttgctgtgtctctgccaggctttggtatcaggatgatgctggcctcataaaatgagtgagggaggattccctctttttctattgattggaatagtttcagaaggaatggtaccagctcgtcctttcacctctggtagaattcggctgtgaatccatgtggtcctgggctttttttggttggtaagctattgattattgccacaatttcagagcctgttattggtctactcagagattcaacttcttcctggtttagtcttgggagggtgtatgtgtccaggaatttatccatttcttctggattttctagtttatttgcatagaggtgtttatagtattctctgatggttgtttgtatttctgtgggatcaatgatgatatcccctttatcattttttattgcgtctatttgattcttctctcttttcttctttattagtcttgctagcggtctatcaattttgttgatcttttcataaaaccagctcctggattcattgattttttgaagggttttttgtgcctctatctccttcagttctgctctgatcttagttatttcttgccctctgctagcttttgaatatgtttgctcttgtttctctagttcttttaattgtgatgttagggtgtcaattttagatctttcctgctttctcttgtgggcatttagtgctataagtttccctctacacactgctttgaatgtgtcccagagattctggtatgttgtgtcttttttctcattggtttcaaagaacatctttatttctgccttcatttcgttatgtacccagtagtcattcaggagcaggttgttcagtttccatgcagttgagcggttttgtgtgagtttcttaatcctgagttcttgtttgattgcactgtggtctgagagacagtttgttacaatttctgttctttaacatttgctgaggagtgctttacttccaactatgtggtcagttttggaataagtgtgatgtggtgctgagaagaatgtatactctgttgatttgtggtggagagttctatagatgtctattaggtctgcttggtgcagagccgagttcagttcctggatatccttgttaactttcagtctcgttgatctgtctattgttgacagtgggttgttaaagtctcccattattattatgtgggagtctaagtctctttgtaggtctctaaggacttgctttatgaatctgggtgctcctgtatttggtgcatatatatttagggtagttagctcttcttgttgaattgatccctttaccattatataatggccttttttgtctcttttgatctttgttggtataaagtctgttttatcagagactaggattgcaacccctgccatttttgttttccatttgcttggtagattttcctccacccttttattttgagcctatgtgtgtctctgcacttgagatgagtctcctgaatacagcacactgatgggtcttgactctttatccaatttgccagtctgtgtcttttaattggatcatttagcccatttacatttaaggttaatattgttatgtgtgaatatgatcctgtcattatgatgttagctggatattttgctcattagttgatgcagtttcttcctggcatcgatgatatttacaatttggcatgtttttgcagtgggtggtaccagttgtccctttccctgtttagtgtgtccttcaggagctcttgtagggcaggcctggtggtgacaaaatctctcagcatttgcttgtctgtaaaggattttatttctccttcacatatgaagcttagtttggcaggatatgaaattctgggttgaaaattctttaagaatgttgaatattggccccctctctcttctggcttgtagagtttctgccgagagatctgctcttagcctgatgtgcttcctttgtgggtaacccaacctttctctctggctgcccttaacattttttccttcatttcgactttggtgaatctgaaaattatgtgtcttggagttgctcttcttgagtagtatctttgtggtgttctctgtatttcctgagtttgaatgttggcctgccttgctaggttggggaagttctcctggataatatcctgcagagtgttttccaagttggttccattctccccatcactttcaggtacaccaatcagacatagatttggtcttttcacatagtcccatatttcttggaggctttgttcatttctttttattcttttttctctaaacttcttttctcacttcatttcattcctttgatcttcaatcactgataccctttcttccaattgttcgaatcagttacggaaacttgtgcatttgtaatgtagttctcgtgccatggttttcagctccatcaggtcatttaaggacttctctacactgattattctagttagccgtttgtctgatcttttctcaaggtttttagcttctttgtgttgggttcgaactacctcctttagctcagacaagtttgatcatctgaagccttctcccaactcgtcaaagtcattctctgaccagctttgttccattgctggcaaggatctgcattcctttggagggggagaggcgctctaatttttagaattttcagcttttctgctctgttttttccccatctttgtggttttatctacctttggtctttgatgatggcgatgtacagatgtggttttggtgtggatgtcctttctgtttgttaattttccttctaactttcaggaccctcagctgcaggtctgttggcatttgctggaggtccactccagaccctgtttgcctgggtatcagcagcagaggctgcagaacagcaaatattgctgaacagcatatgttgctgcctgatcgttcctctggaggcttcatctcagaggggtaccaggctgtgtgaggtgtcagtctgcccctactggggggtgcctcccagttaggctactcaggggtcagggacccacttgaggaggcagtctgtctgttctcacatcttagactccgtgctgagagaaccactactgtctttacaactgtcagacagggacatttaagtctgcagaggtttctgctgccttttcttcagctatgccctgcccccagaggtggagtctacagaggcaggcaggcctccttgagctgcagtggcctccacctagtctgagcttcctggcagctttgtttacctactcaagcctcagcaatggtgggcgcctctcccccagcctcactgctgccttgcagtttgatctcagactgctgtgttagcaatgagcgaggctctgtgggcatgggaccctctgagccaggtgcaggatataatctcctgttgtgctctttgctaagaccattggaaaagcgcagtattagggttggagtgacctgattttccaggtgccatttttcacagcttcccttggctaggaaagggaattccctgaccccctgtgcttcccaggtgaggcgatgcctcaccctgcttcagctcatgcttggtgggctgcacacactgtcctgcacccactgtctgacaagccccagggagatgaacctggtacctcagttggaaatgcagaaatcacccgtcttctgtgtcgctcacgctgggagctgtagactggagctgttcctatttggccatcttggaaccaccccccaatttatttaatttttatagattgccaattatgtagaacttcaaggtaatactgtgtcttagttgtctttatttgcttctatagcctgaaacaaccaaaatacagtaatcatttctgacactcaacacatgcttgctgatttcttaattttgctgcccctattctgcactgttatgccagatgtgtaactccctctttccttggtgttcatgagaaaacaatttgagcaatttcctaactaaggcgtttgtgtgggcagctgacttttcaggtatgactaaatgaatatggtttacatgatacaatgcaggccacttaatatttaagattttaaatgcctctttttaaaagttctttggtggcttttttcatagacctgttatctctgtaggtggtagacttctgtcatgtagccttaatcctttctctctataaacttttcccacttctcccttttatattctttcttgcccatacatttttttcgttaaacaaattcagagtggtttttggtctaattgttctcttctactcatctgtccagagcctcacctttcattcctaacaaagacaattttttttttttttgagacagagtctcactctgttgcccaggctggactgcagtggtgctatctctatctcggctcactgcaagctttgcctcccaggttcatgccattctcctgactcagcctcctgagtagctgggactacaggtgcctgccaccatgcctgtctaattttttgaatttttagtagagacggggtttcactgtgttagccaggatggtctcgatctcctgacctcgtgatctgcccacctcagccttccaaagtgctgggattacaggcgtgagccactgcacctggccgacaatttctttttaagtggagcttagacactggttattgattacttgcaacttgtcctatagcagttgtaaaaaacctctttaatgctttttgcaacaatttggggtgtaagtgaacaaataaaagaaagttttgtatatactacacagaaatgtgtaaatatatgactaaaatatatgcataaaaatgttcatagcagcattatttgtaatggccatgaaaaaaaggaaacaaccaaatgcttatcaacagtggaatgaatagtatgttcatcctatattctgcactatattacattagtaatatagcaccaccaccaccactaccctttaccctgcttcatgatatttcttgcagtgaagatccccacctgataattaacatgtatttatttgtttgttgtttatcttaccaaactagcatgaaacctccaaattgcaaaggatgtgcctatttcttatatagtacaaaatagggacaggaaaattaagaaaccagcaaacatgttagtatctgaaatgattcatatgttttgttcattataggctatagaaactttgctccaacccactgggataggaaaccactaaaaaattgcagtcctaatactgggactaacccgtggcagggaatgttgctgccatacactcctagagacaccacagggcatgcacgtctgatcctgatctgcccatcctgcaccatgagcagaccccaactggagatggaggatgacggtgaacataggcttgtcacccctgatgacactaccagggtcctcacaatcctggctggagggcagcaacagtcacagagcaggggcttggaggggatggctggctggaatcccaggtactaagtaccagggacctagagcaggtggctgaaaacctatccaggggaggtgggaaggcagcaggctgtagggtctataggactaagactccaagtcctgaaacatgctccattgtcctatcagatttcacttccataatacaagttcaaacaaaaaattaaggatttcaagaaagtgactgtggagctttaagcccaaagtacggtgcctttctgagtgttggtcctgtgtggctgcacttatctcatggttgtggagccaggcctgtgtgcaacataagaataaaaaaaaaaaaaagaaaagaaacaaagataactaagtcctaccttaaagttgtacataattgacaatctatagcaatgaaatacaatagagctaatgctacattacagtgacatgggtaaagctccacaattcaatgttgggcagaaaccagacataaaaaaataccgtttgatttatttcgataaagttcacaaataggaaaaacaaatcagtaatgttagaaatcaggatagtggtttcttttgggaaagtggccttagggggacttctagggtactggtaatattttatttcttgaaattcatggaggctacaaaagtatgttcactttgtgaatgttcattgcatttgtatattatgtattatggtatacatagttggtatagtaattataatagctagtttatagtttgtgtattatttatatcatacttcagttacatagtttctttttagaaaggcgagttaagtattctcatttctatttcttaattgtgcaaattaacttagaagattgatttatttggcattgaatcagctgtagaacacaggtctagtgcttctgtatcactgctacagctttcaaaaaaagtttacttaaattaacatccatttagataattaaacttttcctgccattcttcaccttttactttctctataaaagaccatgtagtagatattttgggctttaagggtcatatggtctctgttgtaacaattcaactttgccaatatagtgcagaatcagccatagacaatacataaaagaatgaatgtgatggtgtttcaacagaactttatttataggtaataaaacttgaattttatataatttttacgtattatgaaatagtattcttcttctgttttctttgcaaccattcaaaaatatcaaaaccattcttagttcctgagccatacataaatgggtggcagactagatttgtccatgagcctcagtttgccaacccctgtttaaggaggtttatttgcagtattgatgttagttataatttatatccataatttatgtgtttccttatattcatgggcaaaggagtagcaccccaccttccattctgtcaagctctttaaattgtaacattttcaacttgtttagtatatcactaatttcatggctcataggttaagccagaaagttccctggaaaacacttcagtttgcaagttctctcctgtgttttctttcatttcttccctttgcatttaatgagaataaacaaaatgttctggaataagaacaagtagattcatcaaatgtcaacagctgttgaaccatctgttattgaaaaagtgtttgattagcaccctagggcaatcaagccactttagctgcgggtgtactaagtgaaagaggaaatagaaggcacagctaactaatgatgggtttcactattgataagagcccacctcatttggaaaaagatggacataacaaaggagtagtaactaaaagactgctaataaactgtccttcgtaagaactcatgtttattttggtgaaaatattaaagaaagtcatggaaggtgaaaagaaagagctgaaaaagttacctgttaatatgtgaaatcaaaatctgttggtctgtatgtcattgattctcagttgacttcctgggcttgaatgctagacatttcccacaaatgtggtaccagattttgctcatcgagttttggctacagctgagaatgaaagctattttagaaatgtctggcagactgaactcacagccctgagtgtcataagatgtggtgtagttgatcctacttccataaagctggaaaaaagatgtggtgaagagtggagcaaaaattgctgcaaggaacatagaagaggtggcatacatccacaaacttagcacctaggaaagatttgggtttactgaaacaaatgagaatttggccggtggagattatgggatggaattcaaggcagtaaacgcttctattcaaacagcaagacagtgctaaaggtcatccaaggaaatgcagtaatatgtgactacaactgcatttctttgaatgtgcatccaaaaattccagtattttgtgtaaagtgtgccatgaacacaatcatggcttaaataagtgtttctcaacgtgaacactgctgggacattggggagggtaatttttttgttgtaagaatagtctcacatgctttgcagggtgtttttcatccctggtgccacccactaaattatgaccatatcccccagctattgtgacaactaaaacatctttacatcttcacactcttccaaatgcctgttagagatataataccaccaatcctcattaagaaacgctggtttaaataatacacttcttctatgttgtgaatcttattcacactggaactttgtcaggctatttgatggacaggtggcttatacgctactagagtttgcaaaaatagacgccttggcaataatacatagagatatgaaatgcttcttttgccctacagaagaacaaagtaagaaggacacattaaataaaagatgttcatccctaaaattaaagtatattgttctttattctctcttttatatacataaggggtatattaaagtttgtatttggccatttctaataagcaggacttaaaaaaatttcaatagatttagggatacaagttgtttttggttacatgaatgaattgtatagtagtgaagtctgggcttttagtgtatccatcacccaaatagtgtacattttacccaataggtaacttttcatcccctcccctctccaaccctccctgcttctgagtctccagtgttcattataccactccatttgccttttcatacacatagcttagctcccacttataagtgagaacatgaagtatttagttttccattcttgagttacttcacttaggataatggcctccagttctatgcaagttgctgcaagtgacattattttgttctttttttatggctgagtagtattccatgatatatacacatgtatgtgtatatgtgtatgtgtgtgtatatataaaaaagtatataaaacaaaatcacttttagttacatgaactaatgcctcatataaaataaaaaatatatatgatatacatacatatatgtatatacatcatggaatactggtgtgtatatatatgtggtatgtatgtatgtgtaatatacatatctggtgtgtatatatatatgtgttgtgtgtgtatatatatatatgtggtatataaacatgcacacacacagacacacacacaccccacatttttgttatccactcatcagttgttgggcacttaggttgactccttatttttgcaattgtcctgcaatcaacatacatgtgcaggtatcttttttttttccctttttgcacatatcaaagttttattcaacccattaatgagagaaccatccaaaagacaagatctctacttcctagagtatgtgaacagagatttatagtctgttagcaaagcaatactgaaataagattcctaaattagatacacgttggttagtttcccacagggcaatacagttgtaacttttggggtaatctttcctaccagacccatgaagcaaaaagagacagaggtggaaaggaggaaatggtgatacctcgaactcaggagaaactgatactggatttatctttcgcaatatccaatgtctccttcaaacatctggacctctctcaaggacaccagctattatcttttgcccttgctcttagctgttaaagctttttttttacagaattttcataaccactgctttcttttccttcccactgatacccttacaaacttcagtttcttatcatctcgttgtgaaagtcagttaagcaaacaaaactcttctggagtgtttaagattccagaaaacttctcaaatcacttttcatttctactataagttgttcatttaacaccacaaagacaaatggaactcataaattgtgaatactctgcccctttaagaaaactttagtatgtttttacatttctttttttttttttatttcactttaagttttagggtacatgtgcacattgtgcaggttagttacatatgtatacatgtgccatgctggtgtgctgcacccactaactcgtcatctagcattaggtatatctcccgatgctatccctcccccctccccccaccacacaacagtccccagagtgtgatattccccttcctgtgtccatgtgatctcattgttcaattcccacctatgagtgagaatatgcggtgtttggttttttgttcttgcaatagtttactgagactgatgatttccaatctcatccatgtccctacaaaggacacgaactcatcattttttatggctgcatagtattccatggtgtatatgtgccacattttcttaatccagtctatcattgttggacattagggttggttccaagtctttgctattgtgaataatgccgcaataaacatacgtgtgcgtgtgtctttatagcagcatgatttatagtcatttgggtatataccctgtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgatttgcatttctctgatgggcagtgatgatgagtattttatcatgtgttttttggctgcataaatgtcttcttttgagaagtgtgtgttcatgtccttcgcccagtttttgatggggttgtttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctcacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagctctctgttctgttccattgatctatatctctgttttggtaccagtaccatgctgttttggttactgtagccttgtagtatagtttgaagtcaggtagtgtgatgcctgcagctttgttcttttggcttaggattgacttggtgatgcgggctcttttttggttccatatgaactttaaagtagttttttccaattctgtgaagaaaggtattggtagcttgatggggatggcattgaatctgtaaattaccttgggcagtatggccattttcacgatattgattcttcctaccaatgagcatggaatgttctgccatttgtttgtatcctcttttatttccttgagcagtggtttatagttctccttgaagaggtccttcacatcccttgtaagttggattcctaggtattttattctctttgaagcaattgtgaatgggagttcactcatgatttggctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttctttctcctgcctaattgccctggccagaacttccaacactatgttgaataggagtgttgagagagggcatccctgtcttgtgccagttttcaaagggaatgcttccagtttttgaccattcaatatgatattggctgtgggtttgtcatagatagctcttattattttgaaatacatcccatcaatacctaatttattgagagtttttagcatgaagggctgttgaattttgtcaaaggctttttctgcatctattgagataatcatgtggtttttgtctttggctctgattatatgctggattacatttattcatttgcttatatggatccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtgcctctggtagaaatccgctgtgaatccatctggtcctggactcttttttgttggtaagctattgattattgccacaatttcagatcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttctcaccttctgctagcttttgaatgtgtttgctcttgcttttctagttctttgaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttcccagtatgtggtcaattttgcaataggtgtggtgtggtgctgaaaaaaatgtatattctgttgatttggggtggagagttctgtagatttctattaggtccacttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgtttttcattgacttggtagatcttcctccatccttttattttgagcctatgtgtgtctctgcacgtgagatgggtttcctgaatacagcacactgatgggtcttgactctttatccaatttgccagtctgtgtcttttaattggagcatttagtccattgacatttaaagttagtattcttatgtgtgaatttgatcctgtcattatgatgttaattggttattttgcttgttagttgatgcagtttcttcctagtctcgatggtctttacactttggcatgattttgcagcagctggtactggttgttcctttccatgtttagtgcttccttcaggaggtcttgtaaggcaggcctggtggtgacaaaatctctcagcatttgcttgtctgtaaagtattttatttctccttcacttatgaagcttagtttggctggatatgaaattctaggttgaaaattcttttcttcaagaatgttgaatattggcccccactctcttctggcttgtagggtttctgccgagaggtctgctgttagtctgatgggcttccctttgtgggtagcctgacctttctctctggctgcccttaacattttttccttcatttcagctttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttgattccattctccccatcactttcaggtaaaccaatcagacgtatatttggtcttttcacatagtcccgtatttcttggaggctttgcttatttctttttattcttttttctctaaacttcccttctcgcttcatttcattcatttcatcttccattgctgataccctttcttccagttgatcgcatcggctcctgaggcttctgcattcttcacgtagttctcgcaccttggttttcagctccatcagctccttaaacacttctctgtattggttattctagttatacattcttctaaatttttttcaatgttttcaacttctttgcctttggtttgaatgtcctcccgtagctcagagtaatttgatcgtctgaagccttctctcagctcgtcaaagtcattctccatccagctttgttccattgctggtgaggaactgcgttcctttggaggaggaggggtgctctgctttttagagtttccagtttttctgttctgttttttccccatctttgtggttttatctacttttggtctttgatgatggtaatgtacagatgggtttttggtgtggatgtcctttctgtttgttagttttccttctaacagagaggaccctcagctgcaggtctgttggaataccctgctgtgtgaggtgtcagtttgtccctgctggggggtgcctcccatttaggctgctcgggggtcaggggtcagggacccacttgaggaggcagtctgcctattctcagatctccagctgcgtgctgggagagccactgctctcttcaaagctgtcagacagggatatttaagtctgcagaggttactgctgtctttttgtttgtctgtgccctgcccccagaggtggagcctacagaggcaagcaggcctccttgagctgtggtgggctccacccagttcgagcttcccggctgctttgtttacctaatcaagcctgggcaatggcgggtgcccctcccccagcctcgctgccgccttgcagtttgatctcagactgctgtgctagcaatcaacgagactctgtgggcgtaggaccctccgagccaggtgtgggatataatctcgtggagcgccattttttaagccagtcggaaaagcgcagtattcgggtgggagtgacccgattttccaggtgccatccgtcacccctttctttgactcagaaagggaactccctgaccccttgcgcttcccaagtgaggcaatgcctcaccctgcttcggctcgcgcatggtgcgcgcacccactgacctgcgcccactgtctggcactccctagtgagatgaaccccgtacctcagatggaaatgcagaaatcaccgtcttctgcgtcgcccacgctggaagctgtagaccggaactgttcctattcggccatcttggctcctcctcgcaggtatctttttgatatagtgaattcttttcctttgggtagatacccggtagtgggatgttgaattgaatggtagatctacttttagttctttgagaaatctccatactgtttttcatataaaataattgttaatgtttaaaagagtgataattttttaaataaaaagaatccttttcttttagacatacactgaaatatttatgaattaaatggaatgtttagtacttgctcttcattggagagtatcttgccccattgaccctccaggattgtttagaatttgtggtgatatctgaacagctcaggcaagctttagggtaacatattcataaagattgtacttcttggagaaaatgaaaatgaatatgcttaatggatcattctgccatctctttatcatccattaacttttcattatctacctctagcagagaaataggcattgcttgttcattgcttccctgaaattagattaaaatgtctcacttgtttttaggttttccacaatttcagcatggtcttggctttagtcttttgagagctatcttcagattttatgtcacttctgtatcatttgtgttaaaaactttgagatcataatatttttctctcctttctcaatacattttaaatttgctgtttgactatgtctagtatttcttctgctattagaagaggtaatttcctatttaaatttctatcctgctcatattacaaactagtccaaaataacatgttaaaatagcagttaaatatgtttcttcaggcttgtgcatgaggatattatcagaaagggaagcatgaggatattatcagaaagggaagaagtgatgaccaaaaaataaaaataaaagagggagagaagactagaatatatctaaggcagttttttcaaaagcaagatttgagttctagcagatattcagataatcgaaactccttatcactaccatctcttgcctgtgctgaatttgtcacctgtgttagggatgattcattcctgttttctacgtggaaatctgaatctgtaataacattatttctttctttctttctttccttctttcttttcttctttctttctttctttctttctttctttctttctttctttctttctttctttctttcttctttctcatctaaatgctctccactagattggcacagtaaggcttatgaatcaataagttttattcttgtatcatatctatgtagccactgttgagtttttatttccaaaatcatgatctttaatagaagcagaaggagaaatactacgtgtgccctcaaaccacctaagtttcctaagtagtgcttcaaggttgctctagttaaattctgactatgttgtttctcacagtgaatcagcagaaacaagtccacatccaatatggttatatgttttgcctgactcacttcagagcaattacttctctatcaaagttttgaaaataattattgtcatcttcatgataagtcttattcagtaatatctcaataatctaactaatgggagtcacttagtttcttttgtcaaaattttgagttatttttagtaagattttaatagtgcttagtccatatactgctatgtagtggtaccataccttagtagaagtagaaagaacatcagaaagggtgtcaaaaataaatcttaacataatggcagtagagtttgtcgggagtgtgacttactagtatgccctaaagttttctaatgctgtaagggagaaatgatgatacctgagatttttgtaatacatgtaaaagtacttcacgaacatttcatgtacacatgcaactataagttagtgtgattgatatatcaacccttgagtccctgtttttattttcattgatgttcttttctcttgtttccttctgtatatgattagacatcatctttgttagtttctttctatatcatacttctgtcttagaggcagtatactgagacagagttttaaaaccccaggtcttctttttttttcctgtaatttattgatttgttgcttatttgtaaagttaggataataatactgatctcatgaacttgttgtgagggttagatagaaacatgatagagaaatcaagagttcttgtgttgaattttttcccaaacccgaatatccaactatgtagtagatggtccctcattgattttcactatttcttctaactcaagtttttaaagattgaaggaattttctcatacaaatatcctcctgtgttctctatcttagtcagtaactgtatgatgtgtcaactagcccaagtatctgggactaatctcttttattccatcaacaattaagttttactgaattgaccatgtataattttaaagcttgtggctctctattccaattttcactacattagttcaggcacttgtgcttttatacctgggttattgcaatggccttctaactctccttttggcatatagaattctctgtcctgtgtccagctcattgtcctccttggtgttggtaggtgttttttacaatgcatatctaatcacctatctaatcccttgaaatattaaacagcaatggtaatagtaagcagagaaccttatgtaaaaattcatctaatgttcttccatcaagggtaagatcatattaaaaaagcatccactgagtcctgttttattaactattttcttcttttttaaaattgagaattgctgctaaactatgctaaatgcattttctatatctgtggagataattgtatgattttctctcctttgagctattaggatttcgtgatattgaacaatttttgcattcctggaataaacttacttggtcatcctgtgttttcctttcagtgtgctactggatgacatttgccaatacattatgtataatttttgcattgataatcataagtgatattagtttgcagtttttttattcttgtgtgaactttgtaacttaaggtatcagtattagcccagcatctttaaattgaatttgtttttttctctcttttatatatgctctgaaacagtttaaataacactagaattgtgtgatctaaaaatattgcgtagaactctccccagaaacatctgagtctggtgctctttatggagtagctcttttatctttctttctgttttcttttttgatggtaattggcttgtttacagttttacatttcttttttcttctgttagttgtgttacattgtaatcactagaaaattttccatttcactcaagttttaaaatgtatttgagtatagtttcataatacagttttcaaaactaaaattgatttatatggttatttggcctttgtcatttcttattttgtgtatttatgctctttcatttttattaaatcattttctattttagaaatgtatccaagtagcagattttaatttatatatcggttttactgtttttctgtttcctatttcatcaattttgaatggatacttaaagttcatatgctaaatgactatagatgcatagatttgactttaaaattcatgacataacatgtaaaatgtgtgcattcaataagtacttattgaatgaaatttttctcttatatattggagaatatttgaatatattacacatttagaaagtacacttgggttttttagtttttttttttctttttgagatggagtctcactccgtcacccaggctggagtgcagtggcatgacgtctgctcactgcaacctccgcctcctgggttcaagcgattctcctgtcccagcttcccgagtagctgggactacaggcgcatgctaccacgtccagctaattttttgtacttttagtagagacaggttttcaccatgttaaccaggatggtcttgatctcctgacttcgtgatctgcccgcctcggcctcctaaagtgctgggattacaggcgtgagccaccgcacctggctgggttttctagtattttatcaggtttgtcttttatggtgagtggttaatctgtccttagaattttcatgctaatattttagaaaaaagttttatgggctaagatttctgaaaggactgaagtggtacatcagtgaaaagtgtgctaaattgtagctacaactgcttttggactattagaaagaaagaaactaaaacgccatttgcaaaataaaagtctttatcaatggataatgcaagacatttaataattgctatgattaaagtctggggatattgttggtttctctgtagatatttttaatcttttggtgtaatataggaagtgccactataaagtaattaatatagtaatgttttatgtggcttatagcaagtatgccagtattctcagaaatgatatcaagagtggagaaaccaggatgagcgtacaccaaaatgtgtacagggagacattgtagctagtggaaagagaattggaataagagcaagaagaaccctgactctgcaaacagctggtcatgtgaatgagcccaaattacttgacgttttttacctgcaaaagcattgggttgtccctattcatcctttatatccattttatgatatcatgattttaggtttaaaataatttaaatgaccaatgaaagtgctgagattatgtgtagctaattagttcagaatgattatgtctaaaaaattaaatgtagattaaagttgtgtgtatgtgtgtgtatgtatatacgtgtgtatgttagagaaagagtttaaaagaagaaagcttaaagaggatgattatttgtgtaagatgcaatatggtagtaaaacttgcaatactttagtttgtattttatatttgggttattttgcttgtttcactgaaattgaaaaatattcagatcacatctaaactgagataagcatcttcaaatgctttttattaggttactttatattggattaaatgtggtttcagttgaatgaaatgtaaaaaggtgggtgtggaaaatcatgggatgaaaactgatgctagagaatttagaagctccatattaatttgttggtttatctctacacctccgtatctaacacaatacctggcccataatgaattctcaataaatctctgttggattgaattgtggcagtaaatagcaaaaataaagtatatagcaggtcattcactgttttaatataaagtctatactcatatacatatctttgtagtgcatgtggttacattttgctttgcagtaataacattgaaggttttacttgaatgaagcaggttgtcttgaatggatggttgctattttagtcttattcatcagtactttacataaaacacaaatttttatatttatctaaaaatattaatgtaaaacaccatagtaagtagcaaaattaaagagtaagggggaatatttcttacagtgcttttaacaggacaaacttccattacatttggcactctcctcactcacttttattgctatttacttatttcaaccaaaatttccttcatagacttaatttgtatgtgtttagcagtacatttaaaataccttacttgaagttgggagctcttcttggatgtttgcagtactctggtgtttcaagccagtcagcttatgataattgtttttgtgcccctttctggctacctcctgtgattaataattggccctgtgattctattttgtattctcttgaaataattctttgtggttttctacttcccaatttttcagaattctgctctcatctttcatacatcataaccccaaatagagtcttcaggtaattctctgcttttcaagaagagtgaaagctagaaacctgttttgtttgctgacctttgcttagagtcactagcacaatatttacatttaacataattgcactctcatattaatcacttgctttttatgtggtttgtttttatttctctgaattttaaattgagcacagagattatgtgtcatattaggttttgtgttttcacagcacttgtcacctgagactcactcaatttatatccagaatttgtaactgaaaatggtttcaggtttcttttactcctttcttcttttgtgaatctctacagcaacctgtaatgaatattattattgactttcaatactgctgctctgaaagatttagagatagatctaatatctttatggctacaaaaaagaatggataagcaaatttttattgcctttagtgactcattaaaatattttaaaaacataattcaagaaataataaaatcatgaaagcatgaattcagcaattattttgaaaagtttagcattttttctatacttggctctgtcataatgttattccaggcagaaaacttatatatctttctttgtggtctaaaaagattaaatcttcttgttacaataagaatgtcatttttttcttgttagagccccattactggtagagaatatctggtcctagttaccaataaggaaaaataaattttttagaaaatgtatcttttattcaatctgaattctacttaattttccatatatcaaatagtttactcaaatatagcttccagtttaatattttatgtgatttgtggtatatgttagtcatgaaactttttaaaaactttttttttatttcaataatacttttggggaacaagtggtgtttggttatatgaatgaattctttagtggtgatttgtgagatttttgtgcctccatcacccgagcagtgtacgctatacccaatgtgcagtcttttatccctcgccaccccccaatcctttcccctgagtcccaaaagtccaatgtatcattcttatgcgttttcatccttatagcttagctcccacacaggaatgagaatgtatgatgtttggttttccattcctgagttacttcacttagaataatagtctccaattctatccaggttgctgtgaatgccattattttgttccttcttatgggtgagtagtattccatggtatacatatatcacattttctttatccactagttgattgatgagcatttgggctggttccatatctttgcaattgtaaattgtgctgctataaacatgcatgagcaagtatctttttcctatattgacttctcctctgggtagatacctagaagtgggattgttgggtcaaacagtagatctacttttagttctttaaggaatctccacatcattttccatagtggttgtactagtttacatttccaccaacagtgtaaaaatgttccctttttgctgcattcatgccaacatctgttattttttgattttttgattatagtctttttttgcaggagtgaggtggtatttcattgtgcttttgatttgcatttccctgataattagtgatgctgagcatttttccatatgcttgtcggccatttgtatatcttcctttgagaactgtctagtcaaccccattttttgatgggattgtttgtgtttttcttgctgatttgtttgagttcattgtagattctggatattagtcctttgtcaaatgtatagattgtgaagattttctcccatgctgtggattgtctgttaactctgctggttatttcttctgttgtgcagaagctttttagtttcaataagtcccatctattcatttttgattttgttgcatttgcttttgagttcttggtcatgaagtatttgcctaagccaatgtctagaaggggttttccagtgttaacttctagagtctttatggtttcaggtcttagatttaagtctttgatctatctagcaattagttgatttttgtataaaatgagaaatgaagatccagtttcattcttctgcatgtgacttgcctattatcccagcatgatttgttaaatagagtgtcctttccccactttatgtttttgtgtgctttgtagaagatcaattgactgtaagtatttgactttatttcttggttgtctattctgttccattggtctatgtgcctatttttcataccagtaccttgatgttttggtaactatggctttatagtatagtttgaagtcgaataatgtgacgttttcagatttgttctctttgcttagtcttgctttggctatccaggctcttttttggtactatatgaattttagaattgtcttttctagttctgtgaagaatgatggtggtattttgatgaaaattgtattgaagttgtagattgcttttggtagtatggtcattttcacaatattgattctactcatccatgagcatggaatgggtagaatcaatattgtgttgcttgtgaattctctcagcagtgttttgtagttttctttgtagaggtttttcgtgtccttggttaggtatattcctaagtattttatttctttttaaagttgtggtgaaagtggttgagttcttgatttgatttttagcttggtcactgttggtgtatagcagagctactgatttgtgtacattaatttagtatcctgaaattttgctgaattcatttgtcatttctaggagctttttggatgaatctttagagtcttctaggtatacaatcatatcatcagcaaatagtgacagtttgacttcctctttactgatttggatgccctttatttctttctcttgtgtgattgctctggctaggacttccagtactatgttgaatagaaggggtgaaaatgggaatcttgtgttgttccagttctcagggggaaagctttcagcttttctccatttagtataatgttggctgtgggtttgtcatagatggcttttattaccttaaggtatgtctcctctatgcctatttttctgagggttttaatcataagcagttgctgaatttcatcaatagtttttctgcagttattgagatgatcacgtgatttttgtttttaattctgtttgtgtggtgtatcatatttatcaacttatgtatgttaaaccatgcttacattcctgttttgaaacctacttgatcatggtggataatctttttgatatactgttgtattcagtttgctagtattttgtgaggattttagcatccatgttcatcaggtatactggtctgtagttttttttttgctgtgtccttccctgggtttggtattagggtgatactggcttcatagaatgatttagggaggactccctctttctctatcttgtggaatagtgtcaatagaattagcaccaattctttgaatgtctgatagaattcagctgtgaatccatctggtcctggacttttattaccatttcaatctttctgcttgttattggtttgttcagagattctatatcttcctgctttaatctagtagggttgtatatttccaggaatttatccatctcctgtaggttttctaggttatgtgcataaagatgttcatggtagccttgaatgatcttttgtatttctgtgatatcagttgtaatctcttattttgtttctaattgagcttatttggatcttctctcttcttttcttggttaatcttactaatggtctatcaattttgtttatcttttcaaagaaccagctttttgtttcatttttttgtattatttttgattcaatttcatttagttctgctctgatcttcgttacttcttttcctctgctgggtttaggtttggattgttcttgtttctccagttctgtgaggtatgaccttagattgtctatttctgctctttcagactttttgatgtaggcatttaatgctaagaactttcctcttagcaccacttttgctgtatcacagaggttttgacagctggtgtcactattattgttcagttcaaacaattttttaatttccattttgatttcattgttgacccaatgatcattgaggaacaggttatttaatttctaggtatttgcatggttttgagggttccttttggagttgattttcaattttattccattgtggtctgagacagtacttgctataatttcagtcttctcaaatttactgagacttgttttgtggcctatcatatggtctatcttggagaatgttctatgtgctgatgaacagaatgaatattctgcagtttttgggtagactgttctgtaaatatctgttatgtttgtttattgtagggtatagtttaagtccattgcttctctattgattttctgtcttgatgacctgtctagtgctctcagtggagtattaaagtcccccactattattgtgttgccatctatctcatttcttaggtctagtagtaattgttttataaatctgggagctccagagttaggtgcatatatatttagaattgtgatatgtttctgttgaactagtgcttttatcattatatgatgtcctctttgtcttcttaaactgctgttgcttaacattttgttttatttgatataagaatagctactcgtgttcaccattccagttgcatggaatatctttttccacctctttactttatgtgcgtccttatgtgttaggtgagtctcctgaaggcagcagaattttggttggtgaattcttatccattttgccattcagtatcttttaaatacagcatttaagcactttacattcaacattagtattgagatgtgaagtagtattctattcattgtgctatttgtttcctgaataccttggttttttttttcattatgttgttcttatacaggtcctgtgagatttatgttttaaggagattctattttggtgtatttcaaggatttgtttcaaggtttagagctccttttagcaattcttgaagtgctggcttggtagtggcaaattctcccagtatttgtttgtctagaaaagactgtatctttccttcatttatgaagcttagtttccctggatacaaaattcttggctgataaaggaggctaaaaataggaccccaggctgggcctggtggctcacgactgtaatcccagcactttgggaggccaaggcaggtggatcacctgaggtcaggagttcgagaccagcctggccaacatggtgaaaccctgtctctactaaaaatacaaaaattagccaggtgtggtggcaggcacctgtaatcccagttacttgggaggctgaggtgggagaattgcttgagcccaggaggtggatgttgcagcgagccaagatcatgtcactgcactccagcctggccgcagggcgagactctgtctcaaaaacaaaacaaaacaaaagaaaacaacaacaaaaaaataagaccccaatcccttctagcttgtagggtttctgctgagatatctgttgttaatctgctaggttttcctttgtagcttacctgatgcttttgcctcagagctcttaagattctttccttcatcttgactttagataacttgatgactatgtgcctgtgtgatgatctttttgcaatgaatttcccaggtgttctttgagcttcttgtatttggatgtctaggtctctagcaaggctggggattttttcctcaattattccctcaaatatgttttccagacttttagatttctcttcttccttgggaacaccaattattcttaggttcagatgtttaacatagttccaaacttcttggatactttgttcattttttaaagttcttttttctttgtgtttggtggattgggttaattagaaagccttgtcttccagctctgaagttctttcttctgctttttcaattctattgctgagacttcccagtgcattttaaacttcttgtgtgtccttgatttccagaaattgtgattgttttttatttatgcgctctatttcactgaagaatttttttcctttcatatcctgtatcatgttttttactcatttagttgatcttcacctttctttggtgcctccttgatagcttaataattgatcttctgaattctttttctggcaattcagagattttgtcttggtttggatccattgctggtgacctggtgtgatcctttgggggcattaaagaacgttgttttgtcatatttccagagttgtttttctggttccttctcattttggtagactatgtcagagggaagatctggaattcaaaggctgctgttaagattcttttttcccacagagtgctctcttgatatggtgttctccccattcccctaggaatggggcttcctgagagctgaactgtagtgattggttttgcttttcttggtctagccactcagcagagctactaggctctgggctggtactagggagtctctgcaaagagctctgtgttgtcatctgtcttcagattttgcagctgtggatgccagcacctgctctgatgtgggtagcaggggagtgaagtggactctgtgagggtccttggttgtgtttttgtttagagcactggttttgtgttggtcggcctccagccaggaggtggcactttcaagacttcatcagctgtggtcctatagggaggatgctaacttgctctagggatacctggttaggtattctgatgtctcaggcagtgggcagagccatagaactcctaagagattatgatctttgtctttggctaccaggttaggtagagaaagaccatgaggttggggcagggatagatgtgtctgagctcagcctctccttggatggggcttgctgtggctgctgtaagggatggggatgtggttcctagtccaatggagttacattcccagggagattatggcttcctctgctgagtcatacaggtcactagggaagtgggagaaagctggtagtcacaagcctcacccagctcccatgcagcctgtagtcctaaaggcctatgtcattcccactgtgccccctcaatagcactgggtccatttccaggcactggtgatcaggtgtgagaacatgccccagagcacaagcctccctgttgagaaagcaagcaaactcacactttttcaccatctcagggagcctgcagcagtgatccagttccttcaaagggtccatggattctcttggctttcctgatgtgtccctatggtagttcttggagcaaaagttcatgatgtgtctccacatactgctgtgtccatctgagctggagctgcaagctagtcctacgttctattggccatctcctacaacagttctggtcatgaaattttaagcacaacagagcatatcacatctattaattatgtattgacttgcttcaatattgctatgaaaactttgaaagttaagaatagagtactatgtaattattttaatatttttgcatgcccattgcaaatactacccagtgcacagaacagcccctcacaacaattattagatccaaaatgctcatagtgctgagattgagaaactctgatttagatcgctgatatgtgaaataaaatctattagcctctgggaattattttctttctgccattaaaagatgtagaggatgacattgcttctttaatttaatttaattaattaattaatttattttttgagacgaagttttgctctgtcacccagtctggagaacagtggcatgatgttgcctcactgcaacctctgcctcctgggttcaagcgattctgttgcttcagcccagataacttttgtatttttagtagagatggggtttcatcatgttggccaggctggtttgaaactcctgaactcaagtgattcacctgccttggcctccccaagtgctgggattacaggtatgagccactgtgcccagttctgagattgctttttttaagtttttttaatttttaattttgggactgcttcttgtactgctggatgttgtcttgtctaaatgtgatacctggaactctggtagccgtcttgtgactctgaggggaacctaggtgtattagttatggttctccagagaaaccattaacaggctatacctgtatctatcatctatatctacaaagagatttattttattataaggtattggctcatgtgattataaaggctgagaagtctcacaatctttcctctgaaacccagaaagactgatggtgtagtttgaaggcttgagacctggagagctgatggtgtagatttcccttctgagtctgaaatcctgagaaccaagagcatcaagggcagaagatcaatattccagctcagtagtcagtcagagagagaaagagaaagagataaacaaattccattacttcatatttttgttctatccaaaccctcagtggattgggtcatgcccactcacattggggaagatgaatttctttgctcattctcctaattcaaatgctaatttcctcctgatacatccttatagacacacttagaagtaacataagtaatgtttaaccagatgcctaggcatccctgattcagagaggttgataaatacaactaattgtcacacatccaccctttttcaacttggcacccatatgcatctccttaaattatatttaatctccagacagagacaatagcaagaccatagttctgccatgatataattacactgcatacaaccaaaaatacactccctcttctgtcttagtctgctctgaatgctataacaaaataccttagactgggtaatttataaacaatagaaatttattgctcatagttctggaaatggggtgtccaagatcaaggcaccagcatattcaatgtctggtgagggtttgctttctgcttcaaagatggcacctacttgctgggccctcacatggtgggagagggcgagggaattcatttgagcttcttttataagggcactaaccccttcatgaaaatggatccccataacttaatcacttcccaaaggcctcacctcttaatactattacatttagcattatgttccaacacacaaattttggggggacaccaacattctgatgatagcacctttcctaaaagaagaggtaaatcttggagtgttgtttactctttttatgaatattctgtaatttaataattttgttgtaaaataaaatttatgttgtactcacataaaatcagtacatcttgttatatgataggggaataagagagagaagaaaacgatattttcagatacacacagaaacacatatgttcataacaaagtactcatgacaattacagtcttcatttttataactgtttacatgagttttataactagttacttgatttttataacttgtcacaggattgtagctgatataactggtacatgtaactgccttcttccattacccattttgtatggttttggttctatatctggtagattgacccaaacctttttttctgaaaggtctgtcattagtagtcctgtctgaattgagttgtgatagttttccattgatctaaatcacaaggcatgctaataccaaaaggcatgctaaaagatctactgcattcaagacattgtttttcttctattgtggagtagtagttcaattttcccctggtcattagcatcaatcaccaacatagtaactttgttcttttcttattgattcagaggcatgaggaattcaaagtgggcaggtggcagccttaacttccagttcaatggaatcattgctgtgtctcctggtagaagcatcttctctttgagactaggacatccaggccagcagaatatcaggttgcatgaataggaagcaaatattttgttagtgggtcactatggtaatagcagcaccactcctttttcacttcttgatttctgaacctgtaaatcctggctatgatggaaacagcatcatttatcagacgttgattcagagcatatcctcagaatcttgccccatccttgcaagttcttgccacccagctggtagttaactgagtctttggaagaatatcccaccattctatcaaaccagctgttttaggatggtggtggaacatagaaaggccagtaaaattccataagcatgggcctcttactgaactttttttgttgtgaaaggagatccttgatcagaagcaatgctgtgtggaatatcataatgctggataagacattctataagtcaacaaatgatagttttggcagaagtattgcatgcagtgaaggtaaatccatatctagggtaaatgttggttttagtaagaacaaaacactgctcttccatggtggaagtggtccaatgtaatcaacctgccaccaggtagctggctgatcaccctggggaatgatgccatatcagggaatcatatgtgttttttactgctggcagactgatcactcagtggtggctgtaaccaggttggccttggtaagtggaagtccatgttgctgagtccatacctaaccttcatttctgctaccatggccactttgttcatgagcccactggatgatgacagatgtggctggggaaagagatagattgctagccacaaaaacaatcatcctattcacttgattattaaaatactcctctgctgaggtcaccctttggtgagcattcacatgaggcacaagtatcatcatgttttttgcccattcagagagatctatccatatacttcctccacaaatttccttgtcaccaattttccaatcacattccttcctagttcctgaccaccctatgccccagctcaggaattgatatacaatcacaaattaagtcatttcttcttttaagaaaaatgaacaaccaggtgcactcccctatgttctgctcaccaagagacattttcttcaccaggaaattgcccttcagtgatgtcccagaaagtggttgtagtgctgctgctgtctttttggtggtgcttgtacatcatgcaaaaccatctgtaaaccaggcctgagtctcttcctctgccaactgattagagaaaacaactcatgagactgtaggtacagactcagagggagacagcagtgtagcaagggtggggaccatgggcatttgggccaattcttcatgttacttgttccttctggatgtccttagttctgatcacatacgtatcacttctacttgatgtagagatctgctgtacgtgctcaactttatggcatggtaagacagatgacattcagtaaatgatgagcagctcaggttccatggttacttggtggcccattgtcaagcattcagcctctactaatgcccagtagcaagccaggagccgtttctcaaaaggagagtattatctgtggtagatggcagacctttgccctgaaattccaaaggactaccctgcaattttccaatagggtctaccagagactccaagtagcatcctatctgccatttctacctttcaactactattgtatctgcttgatcatatggctcaagtagcagagcaacttgcacatcagcctggacttactggggagctttcttttgctctgaaccccactcaaaactaccagcttttggaggcatcacgctatctgacttcaaactatactacaaggctacagtaaccaaaacagtatggtactggtacgaaaacagagatatagaccaatggaacagaacagagccctcagaaataataccacacatttacaactatctgatagttgacaaacctgacaaaaacaagcaatggggaaaggattccctatttaataaatggtgctgggaaaactggctagtcatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttgcaatctactcatctgacaaagggctaatatccagaatctacagagaactctaacaaatttacaagaaaaaaaaacaaccccatcaaaaagtgggcgaaggacatgaacacacacttctcaaaagaagacatttatgcagccaaaaaacacatgaaaaaatgctcatcatcactggccatcagagatgtgcatatcaaaaccacaatgagataccatctcacaccagttagaatggtgatcattaaaaagtcaggaaacaacagatgctggagaggatgtggagaaataggaacactttgacactgttggtgggactgtaaactagttcaaccattgtggaagtcagtgtggcgattcctcagggatctagaactagaaataccatttgacccagccatcccattactggctatatacccaaaggattataaatcatgctgctataaagacacatgcacacgtatgtttattgcagcgctattcacaatagcaaagacttggaaccaacccaaatgtccaacaatgatagactggattaagaaaatgtggcacatatagaccatggaatactatgcagccataacaaaggatgagttcatgtcctttgtagggacatggatgaagctggaaaccatcattctcagcaaactatcacaaggacaaaaaaacaaacaccacatgttctcactcataggtgggaattgaacaatgagaacacatggacacaggaaggggaacatcacacaccgggacctgttgtggggtcgggggggagggatagcattaggagatattactaatgctaaatgactagctaatgggtgcagcacaccaacatggcacatgtatacatgtgtaagaaacctgcacgttgtgcacatgtaccctaaaacttaaagtataataataataataaaaaaacaaaaacaaaaacaaaaaaacaaagcaaaacaaaacaaaaaaaacaaaactaccagctttttaagtcactaggtaagggggctggagtaacacacccaaatgaagaatacattgcttccaaaattgaaaggggcccactaggcactgtgcctttttcttaccgtaggaggggccagatgcatcaacttgtttttcacattagaagaaatatcccaacatttcccataccactgatccctagaaatttcactggagtagaaggcccatgaattttagtcagatttattttatatcctttgacatgaaaatatcttacctttacgtctagagtagttggtacttcttaattactgtgtccaatcaacatatcatcaatgtattggaccagtgtgctttcttgtggaagggaacaatgatcaagatccccgtgaactaaattaagacatagggctggagggttgatatgtacctgaactacaactgtgacattgttttgctgactttgccagctgaaagcaaactgtttctggtgggccttatggacaaatatggagaaaaagtatacttttccatagctacacactaggtactaggaatgtgttaattttctcaagtaatgaaaccacatttggtacagaagctgcaattaaaattaccatctggtagatcttacaataatctatggtcattctgtaagattcatttgtcttctgcataggccaaatgggagagttaaatgggaacgtgatgggaaccactaccctgcctctttcaagtcctttatggttgcgctaatctctacaatctctataggaatacaatgttgtttttggcttactattttcctaggtggaggcagttctagtggcttccattttttctcccataatagccttcattccacagattaggaatcaatgtggggattctgccagttgctgagtgtatttactctattatttattttttgagacagagcctcgctctgtcacccaggctggattgcagtggtatgatcttggctcactgcaacctccgcctcctgggttcaagctattctcatgcctcagcctcctgagtagctggaattacaggtgagcaccaccacacctgactaagttttggcatttttagtagagacaaggtttcgccatgttggtcacgctggtcttgaactcaagtgatccgttagcttcagcctcccaaagcactgggtttactggcgtgggccaccatgcttggccaattctaattatgctttctcagaactaaagaaataaccacagggtgtatttgaggaccttctgtgagatggacctgagctcaaactccattgatcatctgactcaataaacttctactgtgactagtaggccacagtgatgttttgggtctccaggaattaatgtcagtttagagccagtgcccaggagcccctaaaagttctgattattcccctttcctcaatgaacagttaccctgataactgtatgtccctttggggaagggtgggagaaagattagctgtacaaatttttggcaatgtaccagggctcttcctcaaggggaattggctaccctttcacccgaggtgttctgagtctgtaaactggctaaagtagaaaaacagattaaggaacatgtgtctctgtttttctgattcagattagacttttgtttacttgacctagaacttttctgcttatacacatcaaatatatatttcgtggtttcttattcatttcacttccaggaatgtcatgatcaactagctaattacacaggcctgtacgagtcagaccattctgcttgctgctttcactttgttatccatcacagtaacaatgcccgccatgcttttgatagctgagtgctgtcacttggctcctgccactctaggatctaattactctcattgtatttatgtttctcagtgtagcatgtgcagtttccactgcaagttccggcttactgagaagagcaatcttgagccctgtagcccaatgttgaagctttcctcacagattaatttctcacagtaatggtgtaaggtatgtcttctggatcctcccagcacgggtgggtaggtcttcagtaacaaatccactctaacattcttttttttttttttttttttgagatggagtcttgctgtatcacctaggctggagtgcggtggtgtgatctcagctcactgcaagctctgcctcccaggttcacgccattctcctgcctcagcctcctgagtagctgggactacaggcacccaccaccatgcccagctaattttttgtatttttagtacagatggtgtttcactgtgttagccaggatggtctcgatctcctgacattgtgatccgactgccttggcctcccaaagtgctgggattacaggcgtgagccaccgcgcctggccaatccactctaacattctaatctccttaatctccttaagtgtttgtatttattcctctacattcaacaaaggtaggttgggcatttccagtttccttactgtgggctacgttttggtctatttcagcccaccaacaaatgtactgctagagttcattctagctccctgagctcaagattacatgcaaaatctctgcttagtgagctgatatcagtagatttagcttgatccatatttatgttgcttctatggttacttcacacctttacaatccattccctgacatatttcctagattgtaatatgtataaattagaaaactcgggtagttcttttggagtgtaatgtaccttctcatgggtcacattttgtaccttacattaggggcctgctggaacttgagtctatttataggtctagaaacaaataggtgggtctttggtggaggtggatccctaggagaatcagcattgtcttgcagggcaactgcatcaagggaggccattacagttttctcaggcaacgcaaggttaatactcagctaggcatagaaaggctgataataaaagatgtgggaaggttgctactgctgggagtgaggagatctctttcactttcaaagaagactcatcagaatttagaagcttattgtctctagcatcattagggtcttcccacatgtccccatcccaacttacaatatctcattctttccaatcaaagttcattttaacagtagacactctgtgaggctgatagttcaacttgaattgtaatttagccgatcataggagaggacccgtgtttgatttccagcaagctcagccctgtagccgcaggagataaggattttgttcagaacaaacataggagatttctgatcattttaaaagcacttcatcgaggaatttgaatccctgagtgcatcctcttttttttctttttttcttttttttttttttgtccagcaacattaggagcaaccagctagtcttattctattagttagttttaaaaaatgttctgaagtagtcacccagcttccttccttttttcttcctttctttctttctttgagctaggatcttgctttgttgcccaggctggagtgcagtggcatgatcatcccctggctaattttaatttttttatagatacaaggtcttactatgttgcctaggctgatcctgaactcctgggctcaagtgatcctcctgcctcagccttctaagtactgggattataggtatgagccaccacacctggccagctcttcgcttcttataaatggtagtatccaattcagatattttatatatctctattgccatgttatgccatggttgatcattgctctctttattactggactttaattggattagaaagccagttccagaaattttagaaaaccaattcagaatattcatgcttaaaattctgttcccctccagaacaactcctggcaccaaacctttattagttagggttttatagagaaataaaagcaatagaatatctatagtctatattctagttagagtagaaatagctaaatacaatttgacctgataactcaatagacttaaaaggctggttgtgctcacaacttcttttaaaacgaggtgttttgcactgcacgtattgtaatatttattaccactgaataattttctttttttttaaattatactttaagttctagggtacatgcgcacaacgtgcaggttagttacatatgtacacatgggccatgatggtgtgctgcacccattaacttgtcatttacattaggtatatctcctaatgctatccctccccattccatccaccccacaacaggccccggtgtgtgatgttccccttcctgtgtccaagtgttctcattgttcaattcccacctataagtgagaacatgtggcatttggttttgtgtccttgtgaaagtttgctgagaatgatggtttccagcttcatccatgtccctacaaatgacatgaactccaaagctggaggcatcatgctacctgacttcaaactacactacaaggctacagtaaccaaaacagcatggtacttgtaccaaaacagagatatagaccaatggaacacaacagagcccccagaaataatactacacatctacaaccatctgatctttgacaaacctgacaaaatcaagaaatggggaaaggattccctatttaataaatgatgctgggaaaactggctagccatatgtagaaagctgaaactggatcccttccttacaccttgtacaaaaattaattcaagatggattaaagacttaaatgttagacctaaaaccaaaaacccaaccagtacctgccactgcaaaaacatgccaaattgtaaagaccatcaatgctaggaagaaactgcaactaatgagcaaattaactagctaacatcataatgacaggatcaaattcacacataacaatattaaccttaaatgtaaataggctaaatgctccaattaaaagacacaggctggcaaattggataaagagtcaagacctatcagtgtgctgtattcagagactcatctcaagtgcagagacacacataggctcaaaataaagggatggaggaagatctaccaagcaaatggaaaacaaaaacaggcaggggttgcaatcctagtctctcataaaacagactttaaaccaacaaagatcaaaagagacaaagaaggccattacatagtggtaaagggatcaattcaacaagaagagctaactatcctaaatatacatgcaccaaatacaggagcatccagattcataaagcaagtccttggagacctacaaagagacttagactcccacacaataataatgggagactttaacaccccactgtctacattagacagatcaacaagacagaaagttaacaatgatatccaggaactgaacttggctctgcaccaagcagacctaatagacatctgtagaactctccactccaaatcaacagaatatacattcttctcagcaccacatagcacttattccaaaattgaccacatagttggaagtaaagcactcctcagcaaatgtaaaagaatagaaatgataacaaactgtctctcagaccacagtgcaatcaaactagaactcagggttaagaaactcactcaaaactgctcaactgcatggaaactgaacaacctgctcctgaatgactactgggtacataatgaaatgaaggcagaaataaagatgttctttgaagccaatgagaaaaaagacacaacataccagaatctctgggacacatttaaagcagtgtgtagagggaaatttatagcactaaatgcccacaagagaaagcaggaaagatctaaaattgacaccctaacatcacaattaaaagaactagagaagcaagatcaaacacattcaaaagctaacagaaggcaagaaataactaagatcagagcagaactgaaggagacagagacacaaaaataccactgaataattttcaatgctggccttacagaggctattttttcctaggtattatatttgtaattaagagatattcagcaataggcaaactcagtaattatgcaatattcagtaaaagtaaaatttaataaataaaagtaataagtatatgatgggaatttgattttggatgtagaggactattttttcacttttttaaataaaaattttaaggaggttccactttggagagaatagtgtagatttcattttccttatttcttcctctcagtgaaactacaaactctggacattaaataaagaacaaataaggctgaggtgggaagatcacttgagcctggaagacagaggttgcagtgaaccaagaatgcaccactgcactccagctgggcatcacagtcagatcctgtttcaaaaaaaaccccaaaaccaaaaaccaaacaaaagcaacaacaaaaagcaaataagaagactctgaaaggtatgaaaggaagatagacgaagacaaactggccagggaatctggaacacagtggtgataagagccaaagattaaaaacacattccgtaaagggggaaaaaaaacattcaaatgacagcagatttctcatcagcaaccatagatgctagaagaaagtttaggcattacaacattttaaagtgcttaaagaaaagaattattaacccagaatttcatattgggtgaaaatattattcatgaatgaagaaaaaattaaaattctgagatgaacaaaaactaagagaatttgccaacagctacctactctaaaaaatggctaaaggaagttgtctaaacagaaagtaaatgatgaaaaaagaaatcttggaactttagaaatgaagaaaaaacataaaataaaaatatgggtaaatacaatagacttaatttctcctcttcagttttcgaatttatactttacagttgaaaaaaaaaacactgtgtaatgctgtcaatttatgtagaggaaatatttaagacaattataagttggggaggataaagaaacatagagagtgtaaagtttatacacttcattcaaactggtaaaatgtaaataccagtggatactaatgtaatacttagggtaaccactaaaacttttatcagaagaaatacactcaaaaacactagacatgaatcaaagtggaattctaaaatatgctcaagtaacatacaggaagatgaaaaaaagagatataaaaagaccagaaaaatcaacagaaaacagaataaaatggcaaacaagccttgacatatcaatgattacgttaaagtttatataatattcctctctgactttcagttggtgcatttagatcacttacactaatgcattaattaaaagacaaagatcagtagaatggatagaaaacatgaccaactacatgagttttctacagaaaactcacttcaactatatttatacacataagtcaaaagtaaaaggatgaaaaatatatgcaagcattgaggaaaataaaggaggagtggctatattaatatcaaataaattagagttcagagcaaagaaattacaaggaatggagagtgacattacacaatgacaaatgcatcgacccaccaaacaatcttaatgtgtgtgcaccacacaacaaaagtgcacaattatgtaaagaaaaatgaataaaactgaaagtaataataggcaaattcacaattatttttagacacttcaacaaccctttctcaacaactgatacaataagtagacataaaatcagtagaagagctcaacaatatcatgaaccaacaggatttagttgacatttacagaacactccacccaacagcagaagacattttttttcaagtacccatagcaagagacacaatattcagtcactcaacaaatatcaacaaatttaaaaatattgatatcatacagagtgtattctctgactgcaatagtataaaacttgaaattgacaaaggaaaattaacaggaaaacccccaaacactttgaaactaaacaatacatgcctaaaaattccatgggactaagaagaagtcttgaaggaaataaaaacatgcactgaactgaacaaaaatgaaaatacaatatataaaaatttgtagaatttagctaaagaaatttcaagaggtaaatttatagcactaaatgattacactagaaaaacaggaaaaagtctcaaatcaaaaatctaagcttctacttcagtatccataaaagagcaaaataaacccaaagcaagtagaaagaagaaagcaataaaacaagaacatgaatcagtgaaatcaaaaacagagaaacaatataaaagattaatgaaacaaaaaactgttttttgaaaatattaatacaactgacaaagctatagcaaagtaaaaagagagaagacacaaataacaaatatcagaaatgaaatggaagatctctctgtagatcttgaagacatcaaatgcctaataaggcaataactcagacaactccataaacattaatttgacaacttagatggaatggaccaatttcatctcaaaaaacataaatccaatttgcacaatatgaaatagataatttgatagccctttaacaaggaaatcaagtttataattaaacatttcccctcaaaaagaaagctccaggcccagacactttcactggataattctatcaaatgtttaagaattcacactgattctatacaatctgatccagaaaacaggagagaagagaatacttccttactaattctgtggtgcaagtattattctgatactaaaaccaaaaagagacaatgtaaaaaagaaaactgaagaccagtatctcttatgaatatagataacaacttcttaacaaaatactaacaaatagaattcacaaatagaaaaagctggctcaatatttgaaaataaattaaataacaaaattaacagactaaagaaaaagaccatatgactatattggtttattcaggaaaagcatttgacaaaattaaacactcattcatgagaaaaactctcagaaaactaggaatagggggaaacttccagaacattaaacaacatcttaaaaaatccccagctaatgtcatacttaaaaaactgaatgctttcccctaagactggggctagacaaaaatgttgactcaacattgctgttcaacagagtgtgcgaaattttaaccagtgaaataagcaagaaagggaataaaaagcatcagaaaaaaagaaataaaactgtttatagattatatgatggtttacaatgactccaaggattatgggacaaaaggccaatctcaaactgtgagaaaatatttgcaaacctgacacatttgctaaagacaaattttagaatataaagaactctaaaagctcacattaaaaagtaactgaagtaagaaacgagcaaaagacatgaaaagacattccactgaagataatacagtagtcttccctggccatggttttgctttccaaaaccaaaaatattaaatggaaaattccagtaataaacaattcatcatttttaaattgcatgctgtcctgagttgcatgatgcagccttgtgctgtcctgctccaccctactaaggacatgagttatatctttgtccagtgtatccccatgctgtatatacaacttgcctgttagttgcttagtagccaacttggttatcatatataaaaaaaatagtatatatagggtttgatactatcagtggtttcagacattcactgggcatattggaacatatgtaccctaagtaaatgagggggaactattatacacagatgataaataagtgcatgaaaagatggtaagacaaaagacaacaagtgttgccaaggatgtggagaaattggaatttttgcacacttttggtggggatgcaaaatggtatatatgctatagaaaacagtaggaaggtttttcaaaaaattaaaaatataactaccgtatgatccagcaatcccacttctgggtatttatttgaaagaattgaaatcatgatcccaaagagttattagaattcccatcttcactgcagcactattaacaatagccaagatatagaagcaacctaaatgtccatcaatagatgaatggataaagaaaatgtggaatgtatataaaatgctatttagtcttaaaaagaaggaaatttgcagtatatgactacatgagtgaattttgaatgcacttagctaagtgaaataagccagtcacagaaagacaagtactgcatgattccacttatataaagtatctataatagaaaaattcatagaatcgaatatgcaatggtggttacctaggctggacggagggggaaatggtccattacttatcaatggacattgattagtaatggactaacccattacttaaagttttaaagttaaagacttaaagttttagttaagtaacataaataggctctaaagatctagtgtagaacattgtacttatttttaataatatattatacatttaaagatttaagaggctgatattatttggctgtgtcccacccaaatctcatcttgagttcccacatgttgtgggagggacctggtaggaggtaattgaatcatgggggcaggtctttcccatgctatccttgtgatagtgaatatgtctcatgagatctgatggttttaaaaagaagagtttccctgcataagctctctgtctttacctactgccatctatgtaagatgtgacttgctcctccttgacttccaccatgattgtgaggcctcaccagccatgtggaaatgtaagcccattaaacctctttcatttgtaaattgcccagttgcgggcatgtctttatcagcagcatgaaaatggtacagtaaattggtaccagtagagtagggtgctgctgaaaaatacccaaaaatgtggaagcaactttagaactgggtaacaggaagagtttggaacagtttggagggctcagaagatgacaggaaaatgtgggaaagtttggaactccctagaggcttgttgaatggctttggaactgggtaacaggaagagtttggaacagtttggagggtgcagaagaagacaggaaaatgtgggatagtttggaactccttagaggcttgttgaatagctttgatcaaaatgctgataatgatatggacaatgaaatccaggctgaggtggtctcagatggagatgaggaacttgttgggaactggagcaaaggtgactcttgttacattttagcaaagagactggtggcattttgcccctgccctagaggtctgtggaactttgaacttgagagaaataatttaggatatctggcagaataaatttctaagcagcaaaacattcaagaggtgacttgggtgccattaaaggcattcagttttataaggaaagcagaacatagaagtttgaaaaatttgcaacctgacaatgtgatagaaaagaaaatcccattttctgaggagaaagtcaagctggctgtagaagtttgcataagtaacaaggaaccaaatgttaatttccaagaaaatggggaaaatgtctccagagcatgacagaggtcttcacagcagcccttcctattataggcctggaggcctagaaggaaaaagtggtttcatgggccagattcagggtacccatgctctgtgcagtctagggagttggtgccctgcatcccagctgctctggtcatggctgaaaggggctaatgtagagctcgggccatcacttccgaggatgcaagccttaggtcttggaagagtccatgcgttgtggagcctgtgagtgcatagaaatcaagaattgaggtttgggaacctccacctaggtttcagaggatgtatggaaacacctggatgtccaggaagaagtttgctgcaggagtggagcactcatggagaacctatgctagggcagtgtggaaggaaaatgtcgtgtgggagagcccacacagagtcctcactggggcgcttcctagtggagttgtgagaagaaggccaccacccttcagaccccagaagggtagatcctccgacagcttccactatgcacctggaaaagccaaaggcactcaacaccagccagtgaaaacagccaggagggaggctgtacccagcaaagccagagagccagtctgcccaagaccatgggaacccacctcttgtatcagcatgacccagatgggagacatggaatcaaaggagatcattttggagttttaagatttgagagccctgtgggattttggacttgtatggggcctgtagccccttcgttttggccaatttctcccatttggaatggctgtatttacccagtgccctcattgtatctgagaaggagctaaattgtttttgattttacaggctcataggcagaagggacttgccttgtgtcaagtgagacgtcggactgtaagattaatgctgaaatgagttaagactttgggggactcttgggaagggataattggttttgaaatttgagggcgtgagatttgggaggggccaggggcagaatgatttggtttggctctgtcctcacccaaatctcatcttgcattcccatgtattgtgggagggacctgtaggagataattgaatcatgagggcaggtctttcctatgctgttcttgtgatagtgaatgagtttcaccagatctgatggtttttaaaagaggagtttcctgcacaagctctctctctttgcctgctcccatccatgtaagacatgacttgctcctccttgccttccactgtgactgtgaggcctccccagccatgtggaactgtaagtccattaaacctctttcttttgtgaattgcccagtcttgggtatgtctttatcagcagtgtgaaaatggactaatacagaggctaaatctcatgttagtgttttcatcacatgctttttctctaaaaatatctttttaaataaaaaacctaaaaaaactctattataataaagtgacacacacatcacacatagtagaatttgtagaaatataactacctatctaatgatgtaaatttctgtcctaatattcttccctgtgactttaaatcttggttttctataagaatctttaaaaagaatttgatagcttttcagcatttctcagaatactactgtatcattcttgcttatttttcatgtggtacctgtggtataagggcagccattctgagtgtaagtctcctaaggtgatggcctctttatagcagggtctgtttactcagagaatgaggcagtcagtcagttctaaataagatataggtgacatgttaccatgggaataatttcctttattgaagcaatttttaagttcttaaattctgctttatgatcttttctccgagttcatttttttcttaaaatattctttctgaacatataaaacataactgaacaagattcaaaggatgcatgttacaaataggcagattttagttcaaatagcaggaattttctaatagtcaaagatattcaaagatgtgatgtattgttgtggaaaggagcaattaagctagagaaactttgaaatcacttccaactttaaggttatagcaataaagaaaagctgggctgggtgctgtggctcacgcctgtaatcccagcactttgggaggccgaggaggcggatcactagatcagggattcaagatcggcctggccaacacattgaaacctcgtctctatcaaaaatacaaaaattagccaggagtgtgtgcgtgcctgtaatcccagctacttgggagaatgaggcaggaaaattgcttgaatctgggaggcagaggttgcagtgaatggagatcataacacactgcactccaccctgggcgacagagggcaactccttctcaaaaaaaaaaaaaaaaaaaaaaaaaaaagctaacatttatacagtggttttcttttcagaaaaactaaaaaaatggcaagtgttccttttcaaagggaaatgatgcttgctgaaatcacatagagaagttgttgtaaattattaaaattataccccttattaataaacttatttatttattaattcaacaaatatttattaggttctactaagttctaggcatgattctaagtttagggctagaagatctagattaaagcaagtctctgctttcatggagcttatatctcagtggagagagggcaaaaaatacaaggatacatgataggcatgtggtaaatattgtttagagaaacataaatcaggatagaggcaatgggaaataaggggtgaggtgtgtgcttgtcattttatatagattagcaaagaagtcctctttgattaggtgatatttgagcctaaacttcaagaaagtgagacagttatgaagatattttgggtggatagggcgggtgggattgaattccaaataaagacagctgctgtaatgaattaggtatgttggcagaacaccaagcaggacaatgtggctggagtggagtaagaaagagagtaacagaggaagagcttcatcattaataacaatatattgtatatttcaaaattgctaaaggaatagatttttaaaatcctctccaaagaaaaataagttggtgagatgatgtatgtgttaattagcttgactgaatattttacaatgtatagctagatgaaaacatcacattgtacctcacaaatatacagaattattatttttcaattaaaaataaatttgtaagaacagaaaattttagagaagtggtggtggagcagacagtggttaaattataggacatggtaggccatgatgagtcttttagctttgttatgaatgagatgggaagcccttgaaagttatgagcagagaatgacttcatctttctcatgttttaaaaggattgttcttgctgctctgttaagaacatactgtagggtgtaagagtggaagcagagagactacttaagaaggagactactgcaataatctaagtgagagatgcaagtgcattggaacaggcttgggagtgggtagtggtgcaggtaagaagtggattcagcatataatttgaaagtagaaactacaggatttgctggtgaattggatgtaggatgtgagaaaaagaaataaataaaaatattacatccaaaatttttggcttgaacaattggaagaacataatactgaattaggtaaaatgcatcattgaaagtttccaggtgttgaggaatatgtctttgggcttgatgagcttcaacacatggctgttgctgctccttggttcatagttgaagacttggtgaaaatatttacttttcttcttcttgccacttgccaccacatatatgtctgtggtgcctggtaattcatggaagatgagcattagccagtgcttaaataaggtataccagtgacagaacatgaatttaaatattatgagtacaactcaaatcaatcaaggcaggatgatttagaatgcctgtcattttgtaattaggttttatatcattatgtgaaaaattttatgtgactgcttaactggacccattatttggtttctctttttgtctttaactgctgtattcctgcctagctgtacttccaaggctaatctaggttatcaaagcttttctttccttaaaatacaactttcaaaccaatagaaaaagttgacagctttcttttaaaacactactgcatgtcacctttcaacatatccaataaaatgttatttttacaatactgcctaggatgaatgatagtatccattttacttggaaggactttaactgttttctctgagtgatgtttttgggtttctctagggcatactttgagtgagtattctggaaatttttatttcaatttacacaacagtttactagtttttgtatgcttatttatatcagttaatttgacaagaaaatctgtgttgaaaaaatgtgttcatttgtctcatgagtactaaaatgtattatgggactttgaagaaatatgagtatgggttcaggggaataagagacaaaactcagaaataattagatggaacaaagttaaacatacagttacatatcaagaccataaaaatctataagtaactgtagtgttagaatagatttttaggtcagtcctcaagaccattgggattagcaggatagaaacacaagtaaaagcttcaatgattaatgaaataagatcaaaataggtactttaaaagaatgctgtcaggaatcataatcttgaatataaaattagttgctgtggtccagcagcagtgggaacagctaattgttgctgaatggtgttatgtagattgatagtgaggagtggggaaggcactgagaacttccctgggtgctgtaagagtagttagagatgcttttgtttgactttgcgatggcatcaccataacccaccaatgaatgacgagttactaccaatgggcagagcagtttctggaatgtactgaatgcaggtggttgtctgagtgccatgcttcgagaagcccattgtagctcagaggacttgaggaaggctgaacagatcgtacagttggccctaaaatattgagagtctcatactctaaaatcatgtactttcttctgtatggtacacatctttaggctgaatgttgcttatttataactactttttcccactgaatgctactctttagggctatttaaaaactctagagttggcctgaatcttaattttctaaaaacaaaacaaactccaagatcagggagaattaagcagaacaccatagtaggtatgacatgtgctttggaattggggagcgttctgggagaggattctgggtctaccacttaatttcgtgtgcaatcccaggcaaattgcttaattcctctgtgctccagttcttttatcagtgaaatggagtttctaatagtgtctacttcacagagttgttgtgaagaataaatataataatggatgataatggatataaagtgcatacattatctggctcaaaaaatagtagctcatattaacaggtcattttgttggcccactaagaaatatctttccacttccagaaaataataaagaggaaaaaaatctctgtgacgtttagtgtgcactgataggtaatatttaatctcaaaatttgctatttttaaataaaaaaactgctttttaaagtggggatttatctagcgattaggatttaaaatttttgatctaaaaatattcaaactattatagatatttagatttttatagggaaaaatttcattttctttaaggaggataacttccatctcttaatagtttgtagtatatacattaaaatattctggaataagctatcattcaaagtgaagcttaaaactaaaaatcagcaacaaacatttcatagaaactagaaaaattcaagaacaacgcgtcctttggtggtgcaggtctccaggcatgaccagttatggatgtggaaaggaaagccagtgtggaaatgattagatgactagccaaggcacaggtatagttttctttttcaccgtctagaattaatgcaggtttttagttgctttcctggctggcttcggctataaggcagcgggtttgttttctgataacaatccagctttttatgctctctcagatttaaccttacactgattatgttgccccttcacttttgtggtcagctgataacaaaggaaaggagcgcaaagaattcagttagaaattcacatccaaaacagcagacttttctttgaattctactatcagtttgtcttctcttatgatacttatactctgtagtggcattttggtttgcatataaaatttcccctactactgaagtgtaggtattggagagctttacacctaccactagtatttcttttctcacacctgtaacaactgattatcagcccctgctccaaaactttcagtcatcagaggttttacttcataacatatttttggatagataggttcccccaacaccaattttactgagctgaaattattaatattttattgggagaaatcacataacattttagttcaaaaagaataccttttattttggctcattacatttcttcatggatatttcccctagttttctctagttagaatccgcctccacaattcttattagcctgcaactcaaacacattatttttttcaaactggttccttctacatgagccgtctgaatcactaaagcaagaatcaatcagtcagcaatatttatcaagcacacactaggcgcagaaaactgtacaaagagctctaaaagtctgcaatattgattgtacctgtcatgccctgacatgtaaaggcccttatcacaagaaggaggtctccttaatgtaagtttttgattagcaggatgtgggatctggactgcagtgagagaaagagacattgcaaaacttctctgcctgggaaataaacagtaattttggggtggtgggggaggttcggggtgagtaattaagggaggagatatgaggtgaggaaagggtataggcaggtagggacctacaatctgataggagtctagagcctgggaagacacaactgttgaagatgcctctgaggcaaaaatggcagaagggagggctaatccttaactgtaacttgtcggcaatgctgagcagtgatgtgagcctcaggtcctctctccaaatttcagtggagtctcctgtaagaacagctttgagtctttggttgctgaatgacaaaagaagaggccagatggagtgggaaaagggagataagtataataaaatgaacacatgaacctacctcacctaagggagtagtattactaataatgtcaaggctgcctttgcaacattgtacccaagcaaggagcagattctcccaaatttaggagcctagtttattttaatcaccttattcctgagcttttgtttggtctttgcaggcttcttctaggacagtgaggagtaggaagccattggagcatgtggtgatggtggcagcagcaggaacaacagggtgtggggtcatacttaggcacaggtgagaaagattcctaattactatagatcctggctgattgagaatcacttgtctttagcctggtccagcagtgcaaagttaggggctgttgatcttactgaggtggcatgtttcacatctgtccctctgattctgaatatgcatacgcaattactaatcgtgatgtgggaaaggacaaggctttgcacaactactgatgtacctgcttatgtccattgcctagactcatctccttcatgaatttttagatagtcagattgtggtcttaaacctcaaatatctcactcttcaaaggcaaagacttacattttagggcttgttaagagtcttcagcttagcaatatgaatataatacccagaaagtgactgtatgtgccaggttcttgccaggaaagagatggcacactcaaactgggtaactgagtgagttttaaaaaatgacaatttatgaaggcataggtagggtttagtgaaagctgtaagacacaatgcagtgccctagggctagtatcaggtaggaactagcggacaaacaaaagatatcaagctactgccacgttgtttttctgtattttgagggatttaagcgttattcaaatataggctatcttatatcaggtatccggaggctactcatttcagccccgctgaataccatttcctccaagaaggctttctcataagcccagacagaggagctttgttaccctttgaacatctacagcaactgtatttctcatacttattgaacacagcaagatactgctttgaattcattgtacagaaaaacctctctgttaattattaattttttggctcctaaggccaaattggtgtctggcttattttttgcattctcccaaatgcctagcacaatgccttgtacccttttttcccactaaaagttgttgttttttgtttttttgaagttgccagccacagggtagcagggagaagattgatgcctacgcaaatataacagatccttgccttgtgttttcactcttgctaagataatccagtctctgcctggatgctactgacagcatttttagcaagattcatgacatcctccttctatgcaatctctaagacatggagcagcaagaattataaacttgaaatgttactgggatgattgttcccttgttgtgaagtctcttgctgtttacctacttcctgctttagcagtttcttttagactattctcatctgttccattctgaagtctaactccgttttcctcattactctttatcccaggctccttgctctagggttaagcaaagttgcttgttgctgtctcctcagtatgaacagcctaatttgcctcaggttttccacatgcatgttggtaagggccaaataaacgacctattaatatgagctactgttttttcagccagataatgtgctatccactttatatccattatcatccactatcatatttattcttcacagcaactctatgaagtagacactattagaaactactctttagtgatataagaactggagcacagaggaattaagcaatgtgcccaagattgcacaccaaattaagtggtagacccagaatcctctcccagaacgttgcccaattccaaagcaaatgtcatgcctactatggtgttctgcttaattctccctgatcttggggtttgttttgtttttagaaaattaagattcaagtcaactttagagtttttaaataactctaaagagtagcattcagtgggaaaaagtagttataaataagcaacattcagcctaagatgtgtaccatacagaagaaagtacatgattttagagtatgagattctcaatattttagggtcaactgtacaatctgttcagccttctgcaagtcctctgagctacaatgtgctgggatgacaggccctttcttttttaaaaattgaactaacttttagaaattattttaaaaacttttgttttaagcaatggggaaaggattccctatttaataaatggtgctgggaaaactggctagccatatgtagaaagctgaaactggatcccttccttacaccttgtacaaaaattaattcaagatggattaaagacttaaatgttagccctaaaaccataaaaaccctagaagaaaacctaggcaataccattcaggacataggcatggtgggcaaggacttcatgactaaaacaccaaaagcaatggcaacaaaagccaaaattgacaaatgggatctaattaaactaaagagcttctgcacagcaaaagaaactaccatcagagtgaacaggcagcttacagaatggggaacatttttgcaatctacccatctaacaaagggctaatatctacaatctacaaagaacttaaacaaatttacaagaaaaaaacaaataaccccatcaaaaagtgggcaaaggatatgaacagacacttctcgaaagaagacatttacgcagccaacagacacagcaaaaaatgctcatcatcactggccatcagagaaatgcaaatcaaaaccacaatgagataccatctcacaccagttagaatggcgaccattaaaaagccaggaaacaacagatgctggaggggatgtggagaaataggaatgcttttacactgttggtgggactgtaaactagttcaaccattgtggaagacagtgtggcgattcctcaaggatctagaactagaaataccatttgacccagccatcccattactgggtatatacccaaaggattataaaccatgctactataaagacacatgcaaatgtatgtttattgcggcactattcacaatagcaaaaacttggaaccaaccaaaatgtccatcaatgatagactggattaagaaaatgtggcacatatagaccatggaatactatgcagccataaaaaaggatgagttcatgtcctttgcagggacatggatgcagctggagaccatcattctgagcaaactatcacaaggacagaaaataaacaccacatgttttcactcataggtgggaaatgaacaatgagaacacttggacacagggtggggaacatcacagaccggggcctgtcatggggtggggcacagggggagggatggcactaggagaaatatctaatgtaaatgacgagttaatggatgtagcgaacaaacatggcacatgtatacctatgtatcaaacctgcacattgtgcacgtgtgccctagaacttgtaagtataacaaaaataaaaataaaaataaaataaaataggaaaaagaaaaacccaaaaaccaaaaaacaaaaaaaaaaacttttaagttcaggggtacatatgcaggtttgttacataggtaaacatgtgccatgggggtttgttgtacagattattttgtcacagaggtattaagcctagtacccattagttattttccctgatcctctccctcctcccaccctccatccagtgtgtgttgttcccctttatgtgtctacgtattctcatcatttagctcccacttataagtgagaacatgagctatttggttttatgttcctgcattagtttgctaaggttaatggcctccaactccatctatgtccctgtaaaggacataatctcattcttttttatggctgcatggtattccatggtgtatatgcaccacattttctttttcttttccttttgtttttttgagatggagtctcactctgtcacccaagctggagtgcagtggcacacaatctcatctcactgcaagctccgcctcctgggttcatgccattctcctgcctcagcctcccaagaagctgagactacaggtgcctgccaccatgcctggctaattttttatatttttagtagagacggggtttcaccgtgttagccaggatggtcttgatcttctgacctcgtgatccgcctgcctcggcctcccaaagtgctgggattacaggtgtgagccaccgtgcccagcctcgcaccacattttctttatccagtctatcattgatgggcatttaggttgattccatgtctttgctattgtgaatagtgctgcagtgtgtctttataatagaatgatttatattcctctgggtgtatgcccagtaatggtattgctggtcaaatggtatttctgtctttagatctttgaggaatcgccacactgtcttgcacaatagttgaactaatttacactcctactgacagtgtataagtgttcctttttctctacaacctcgctggcttctgttatttttttgttttaataatagctattctgactggcgtgagatggtgtctcattgtggttttgatttgcatttctctgatgatcagtgatgttgagcttttttccataggattattggctgcatgtatgtcctcttttgagaagtatatgttcatgtcctttgcccctttatcgggttgattatttttttcttgtaaatttatttaagttccttatagatgttggatattagacctttgtcagatgcatagtttgcaaaatttttttcccattctgtaggttgtctgtttattctgttgatagtgtcttgctgtgcagaagctctttagtttaattagatcccatttgtcaatttttgctttcattgcaatagctttttgtgtcttcatcatgaaatctttgcatgtgcctatgtccttaatggtattgcctaggttgtcctccagggtttttatagtttttgggttttacatttaattgtttaatccacttgagttaatttttgtatacagtataaagaaggggtccagttccaatcttctgcatattgctagccagtgatcacagcaccatttattaaatagggaatcctttccccattgcttgtttttgtcaagtttgtcaaagatcagatagttgtaggtttgtggtcttatttctgggttctctattctgttccattggtctatgtgtctgtttttgtaccaataccatgctgttttggtcactgtagccctatagtggagtttgaaatcgggtagtgtgatgcctccagctttgttatttttgcttatgattgctgtggccattgaggctcttttttggttccatatgaattttaaaatagttttctctagttctttgaagaatgtcattggtagttttgtaggaattgcattgaatctgtaaattgatttgggcaatagggccattttcacgattcttcctatccatgagcatgcaatgtttttctatttgtttgtgtcctctctcatttctttgagcagtggtttgtagttctccctgtaaagatatttcacttcccttgtttagatatgatcctaggtattttattcttttgtggcaattgtgaatgggagttcatacataatttggctctcggcttgactgttgttggtgtataggaatactagcaacttttgcccactgattttgtatgctgagactttgctgaagttgcttatcagcttaagaagctttcgagctgagacaatggggttttctacatatagggtcatgtcatctgcaaacagggatagtttgacttcctttcttcttatttgaatgtcctttatttctttctcttgcccgattgccctggcaagaacttgcaatattgtgttgaacaggagtggtgagagatggcatccttatcttgtgctggttttcaaggggaatacttccagcttttgcccattcagtatgttggtggctgtgagtttgtcatagatggctcttattattttgacgtacgttccttcaatacctagtttatcgagcatttttaacatgaagggatgttgaattttcttggaagccttttctgcatctattgagatcatcatgtggtttctgtctttagttggctgttatgtgatgaaacacatttattgatttgtgtatattgaaccaatcttgcatcctggggatgaagcctacttgatcatggtggacaagatttttggtgtgcagctctttctttttacctccctgggttattaggaagttgatgttgccctgaggttgtgggggcagatctcagcagaactggaaaaaaaactgcataaagcttgtttctcaatttggcattgtggtattttggggtctacagatagtgttcaaggttttccttaaaaaatgtttgcctttctaacttgggtttattagtataggcaattacatattggatcttgatttttctctcaaacatctgaatgatttctccaagttctattcatctgcactttttaaggcatagagtaaatttttttcatgcaaaatattggtgaaaacattaacataacaatttcttatgattaaatttgatacattaagcaacactctcatttcaggtaggcattaattcactcagttgtaaattatccagatcatatttctctaattaataactacatcattaaaaacttcaaatgctttgctacaacccaaatataatctttatgtcaacctggctatcagaaaacaatattagggctggacgtggtggctcatgcttgtaatcccagcactttgggagaccgagacaggtggctcatctgaggtcaggagttcgagaccagcctggccaacatggtgaaaccccatctctgctaaaaatgcaaaaattagctgggcatggtggcccatgcctgtaatcccagctactcaggaggctgaggcaggaaaatgacttgaactcaggaggcggaggttgcagtgagccaagattatgccactgcacttcagcctgggtgacacagcgagactccatctcaagaaagagaaaatgatattaggtttttgcataatttattctttataatgcaaggttggctgctagtggttagtacttataaatgttcatgcactctgttaatgatttgttcaaaatttttgccagtgattgaaatatgatttgaaagtctgtagtttctagaatatatatttgaaaaatgaaacatgtgtctgctaatcttcagtcttctgccaactcctttattcactacaatgtcttaaatactgatatttgtccttcattatgcttgaaaatccttttagtattagcgataaaatttgtcgtggtccctagtagtgggcttcttgcttcttcgttttgttctgactatattgtttattaccctttccccagaaacaaacaaattaacgaacaaacaaataaaaaacacaataaaccaagccaaaattaaaaccaaaaaccaaaacctgactaaaataacctcttttaattggaaggtctggtctcgggtgctgaaagcccagagaagaggactgcttctaacctgccttctgaggtttccatggtgttcagctattcttgtagagtttactttgctttttaagtatttttgcagcttttaaatgtatttagataacttttcattatactaccacatttttttatgggttaggaatgaaacaataattgccagaagtgcccagaactgtagagataatagcaagaattcacagacaggtgttctcctgagtctatttgcccaatatcagtttgatttgataatctcaccacagaatctcttactcatcacagtattagctacttcttttaaaactttacccctcagcttttgactctgttgttctcctctctgttcaacacaacaaaattccaagtcttatttataaagactgttcactagaacacctaaggtatttagcacacgggaaaaatgtgtgcatataaagtttttattatgctctttcatttgtgttgctgtggtgtatgtctgttctaagtatggatctttgatctgattagttgatttttgtgagtaattccttgatattttaagccagtagaggtgtgctttaattcaagatactaaaacacagttgctaaacagaacttggtactccttaaggattctgccttgtgatatatacaattgttataaggtacatttttcttatccaactatagacaatttaataatgttttaactataagaaaatcttttaggtgaagaatggcgtatatttattgttcactttttgctgaagagagacaaaacaaactgatattgaactgcacataaaggattgaaataaattttgagaaaaatttcttaataatgagaataaaatattagaagagaattctgtctcctttttgggaagtgaggtgggaagaaagaaggtagaaatgaggccactgagagttcatatttggggtagaaaattatattctatgattttcagatgggctttcataagatggtaggttaaagaaaatttaaattagagtctctcttggctaggtgtggtggctcacacctgtaatcctagcactttgggaggccgaggtgggcggatcatgaggtcaggagatcgagaccatcctgcctaatacagtgaaaccccttctctactaaaaatacaaaaattagccgggtgtggtggcgcacacctgtagtcccagctactcaggaggctgaggcaggagaatcacttgaacctgggaagtggaggttgcagtgagctgagatcatgccactgcattccagcctggcatacagagggagactccgtctcaaaaaacaaaacaaaaaaacaaaacaattagagtctctctgggaattcaaggaggatattagagggtgattgtatagcaaacagtattttaagatcttggttaatactacagttttatgattagctgtttttaacgattcagttgcaagtttactttacgtacatcacattttctataattaaaccaaacgacacacatgtattgaacatgatcatatagagggctcttctaagttggctgcaatttgtattttcctaagggcaggcattagtgcttaggggtagaaatgcttactctgaatactcaggttgggtttagatgattcatgaaacttcttctacccacccaaactctcaacttcctatggtttcattattttgtggaagtttaaggatactatgtgggggtgactctccatgtatagtgtatttggcagtctcacatgaggccagtgatgcaagttgatcatgtattatctgaaattctccaggtcacacagtaactactaggaccacccttaaatccaggtgaaagaagcctcttctttgggtgttgttatgagctgaattgtgtcctccctaaagttatattgaagttccagctcccagtaccttagagacatgttaagacttttgactgtaaggccaggaatgggggcaggaagtaatccagaatttacacctgggaaaggaagcattgtttacatatgcagatctctggggtcagataacctttggtgaatcataactttagcattttttgactgtggctgcatcagtccaggtactccaggtagcagatgctaagacaaagttaaaagtgtaagaaatttgttggaagtatacctagggaaagaaaaaaggcagggctagcaggagcaagcagggaaatccttcaggaaatgccactgttcagggtttcaatttcttcttgttttaaacttgagaggttgtatgttttcaggaacttatccatttcttctaggttttctattctgtgtacatagaggtgtttggattattctctgtgggtttttctatttcttgtggtcagtggtaatgtcccctttgtcatttccaattgtgtttatttggattttctctcctttttttctttattattctagctaatggtgttaatcttatttatccttagaaagaaccacgtcctacattagatcttttgtatgttttttttttgcatctcaatttcctttagttcagttctgattttggttatttcttgtcttctgctagctgtgaagtcggtttttcttgtttctctagttcctttaggtgtgctactaggttgttaatttgatatctttctaagtttttgatgtggacatatagtgttataaattccttcttaatactgctttagatgtatcccagagattctggtatgtggtatctttgttattagtttcaaaaaatttcttgatttctgccttaatttcactgtttacccaaaagttgttcaggagcaggttctttactttccacataactgtatagttttaaatgattttaaagtatttatatttttattgcactgtggtctaagagtgtgtttggtataatttcaattttttaaaagtttgctgaggattgtttcatggccaattgtgtggtcaattttagagtatgtaccatgtgcaaatgagaatgatgtgtattctgttgcttttggctggagtgttctgtagatgtctttaggcccatttggttgtgttgagttgggtcgtgcatatcatatctttgttagttttctgcctcaatgatctgtctactacagtcagtggggtgttgaagtctctcactactattatgtggttatctaggtgtcttcatagttctctaagaacttggtttttggatctgagtgccccagtcttgaatgcatatacatttagtatggttgatcttcttgttgaattgaatactttaccattatgtaatggccttctttatcttttttgattgttgttggtattcttttctttaagaatgctgaatataggccctgaatctcttctgccttgtaggtttcctactgaaaggctcatgttaacctgatgaggttccttttgtaggtgacctgccccttctctctagttgcctttactatgttttcttgcacattgaccttggagaatctgaagactatgtgtcttggggatagttatcttgtataggatcttgtaggagttttctgcatctcctgaatttgaatgttggcctctctagcaaggctggggaaacttttgtgaacattatccacaaatatgtcttccaagttgcttgttttctctccctgtatttcaaggataccaatgaatcatagatttggtctctttacataatttcatatttctcggaggttttgttcattctgttttatacttttttctttatttctttctcactgaattagtttggataaccagtcttgagctttgagattctttccttagcttggtctattctgctgtggtctacttgtgattgcattatgaaattcttgtagtatgttttttagctgtatcagatcagttttgttccttcttttaatggccatttattgtttcagcttctgcatcatttcattgtaatacttagattcctcggacttcaactttccctggaatcttgatgatcttcattcctattcaaaaaattgtgaattgtatgtctgtcatcttagctatttcagccttactaagatactctggctttttgagttgccagagttcttgagctggttctttctcactatgtgggctaatgttcctttaactgtgatgtaatttgagtacacttttatttgatttcttttctggatgttttcagagggccaaggctttgtgtagggtctttatttgtagctgacttcttgtccttggtttcacaggagggcatattagcaaagtatttttggtgttgaattttgggctttgatccagtagatggtgtttaagcataatggccaatagctaggctcttgcttggccacgtggctcctctgtgtttcctcatgattgcggctgtgctcccactcagtgctttgaagttgtgggctcctctcctccttcagtgctggctgtagatcttggcttggtataccacagccctggagtgagctcaggctttatgttccttccccaacttggaggcagcagggcaaggggccttggaagtggctgtggcagaggcagaggggctttcatttgtttcttggggctccactcaaaagaaaagcagagccgctgccaattggtgtgactggcctggggtggggcagctgtgttgtgagcccaagctgtggggccctgcctggtgatgaattgggggtggggagctcacaagggagatagagtggtctcttttccttagggagactgcagcttgctggagttgtgggtaaagccttcaggatctttgttccttccccattctaagggcagtaccactgcagtggcaggtgcagagggactttcagttgcctctgggagctctatctcagagaaatgcagagccactgttaatggaaatgttcagccatttccatgtccagccactggaaatgttcagcagtgcaggagtggctgcactgctggcttgagctggggggccctgattggcgaagagtggcggggggggggggggggggtggaaggatcacagagaggagagactgggctcctttccatatgacaacagtgaagtggcctcattgtttggggtgacacccagagcttttggtctcatggccaaggaaatcaaggatgtgacacaccaaggatgaggttgagaatagaaatttaataggaaaaagaaagagaacagctctctgctacagagagggatcccagaaaaagggttgctgtactgcagtgaaatgcaggggtttttatagacgagctagtggggaggtggtatctgatcagcatagagcatgaaaaaccagttaggaccaggtgtgctatctacttagggtacaaatctctggtagccccccaccccaatgttttattatgcaggcagttcctcagcttgagctattccatgttgcttatttctttcttactgtgcatctgctaaaaaggggaggtggaacccccatggtggacgtgcctggtcctttgtagccctttctatctgtgcaacggccagcatcccctcatgcaagcttccagcttccttatctatgtttgcagcccaatcttccagttgctgtttgttagaaaagaagtgatttcttgggctgctttttgtgagaagcgaagttctgtctgggactatttgccctcactatctgtctaaatcatttttatctactcctgtatcaacattggtgtgctggaattgcaagtaaagttcctaggctcttagtcgggtggcagcaaggtcagaatcacttcagtggcagtgacagagcggctgttgtttgcctctggaagctccaccccagagaaacagagccgctgccagtgggaatgttcagctgggggtggggcagctgctctgcagtcatgagcttggggccctgcctggtaaagagtccggggtggcggttcacagggaagaaagtctgggctcctttctgcatgatggctgccatgtgctggggtgccagcatagcgaccacaccctttcttcctctcccagaccgagagcagcaagggcagtaccactgaagctgcaatggcagagggactttgggttgtctctggagtttcctccctggagaaatgcaaagctgccactgactgaagtattcaggctggggcagagtggttgtgctgggggcccaggtggagaggccctccacggtgaggagcagctgaggcacggacctgcatcgaaacagactggccgcttttctgtaaggcaacggaactatgctgagggtccatgttagattctaatcactgcttttcctctggagtccgagggtaacaggagagaggactgtgtagcagcaaacatgagagcctgtctgctgcctctggtagctgcgtctcagggaagtgcagagctgttccccgatggagagctcaggagtggttggggtggctgcattacggtcccaggccagtgggccgtgtccagagaggtgcagtagaggtgaggcctgctgttcatccactgctcagtccacggattcggcccctatcctgggggcatgctagggatcctggcctccgatgttgcaggagctgcagctgctggtgctgggatgcccagggatcaaagagtcccgtacttctcatgtgcctgaactgtgactgtgcccagactccacatggctgtctttttcagtctggaggccccggctgggggagagtcatgggggaatctcttgatttcagggttgcaaagttccgtggcagaaatgtgggtccctaggaactctcactagctcactgtttcttcgcagtgggagtctcccatggctctgcgccactcctgggtgggtggctgtcgtgtctcactcttctctgttctacataggtcgtgttgcttccttgatgattcccagtgcgtcctcctggaagatccagttgaagagctagtatttactcaacactcttctctctgtgagagcggcccacactagttgctcctagtcatttatcttggccggaatcttctctgttctctggttatctccatgtctgccccctgccaacactgacacattaaaaaaaaaaaaaaaaaaaaaaaaagatgccttggaacagttccagaggatgaagtttttttctcactatttatgggaaacggggagcttcgcagccaagctcctcttcagcagcagcacagacccctgcctcttgcctcatttctcacttccaccctggaagttgcagaacacgcatgtgcactgcacaggcctgtgaaggtgggatcagcacgtcctgccaggcaccatctccagcgcaggatactggagctccctgttgagcagtgcaggttatatagaataggttaggagttagggcatagggcttgggttaggtgttagaatctacatggctgattcttgcttacactgttgaatttacttttgaggactaacctgaaaaatggtttctcagattcccttgaatcacaactttacagatattttttgacattttggcagtaacagtttttatagtgaaggtaatataaagatcaggatgagataatacagtcaccaataaaaatatgaaaattgtgagcttgagaaagctgactctggggattgagaacatgctttgaaaataagaccagctattatacatttagatgttaaaactgaatgagatacagaaatcaatttgaatttttgggtgtcaagttgatatacttcaagtgtctaattgttttctaattgactataagatgattttatttttcagagaaaaatactgttgagaaaacagagaaagattttcttttgctgctattttttgctattagtttagaggagctgaaggtggcaaagtgataaaagagtgcctcaggattcacacaaaacttaatagatatttgactcataaacccacggtgtggtaaacctattcccaggtcagaatacaacagtctttgagctaactttctagtgtgtattacacaaagctatttcttttcttatgctctttctagctgggagagtgcacacagtaagaattacagttcccactttacagggaattggggctgtaaccaccttctgatagttgcttctaattattttagtatgaaaatgagtttttcaaaacatatcattaaaaaaatattacatgttgtaaaaagtcaacctgtacataaatttaaagtgttcattcatttacttagcaattatttgttgagtgcctattgtatctcaggcactgttctggtcctgtgaatacatcagaaaatatatccaacaaaaattcttatctttgtgaagcttacattgtaatgggagaagacagataataataaaatagtaataaattatataagatgtttggagtgataaatccaatggggaaaaatagagcaagctaagagggactgggaatacaaaggcagtcggggagattacaacttaaatgaggtggtcagatattaccccatctataaagtgatatttcagcaaaactttaaaggaaatgggaagatgagttatgaggctatcagggaaaagagaatagataacagccagtgcaaaatacctgaggtggcagatgatggtgtagcaggaaccatgaggaggtcaatatggctcaagagggctgaatgggagaagtagtagaaagtaaactagaggagtgaaatcagggatgagaaaggaagttggtggacaaacttgggggagtttgttatgaagtctaagactttttacttggagagaaatttggaggcattggagggtttgagcaggtaaatgacttgttctgacatctttttaaaggagtattctggttgtttatgttaagaatagagtgtacggggcatgtgtggaagcagaatgaatagcaagaaggctactgttaaagtccaggagaaagatgctggcagccaggatcagggggtaacaatgaaggtggtgtggagtttctgggttttgaacatgccagtgttttgaaatgacagccaacaagatttctggataggttatatgtggggtttgagagtgaggagtcaagtatgactctaatctctttggcctgagcagctggaaggatggagctgacattgactgaaattgggatgattcaagtcaaataggttttaggggaaagatcaagagtttcagcttgagatgccagttcatcatccacatagactaagtgagtattggttgaaagtagtcccaggccagagatagaaagttggcatttgtttaaagccatgacactgggtaagctcatctagagaataagtgtacattgagaagagattaggaccaatgactgagctctaggaattacagtcttttttttgttgttgttgagaaacttctccaattttgttttattttattttaattaattaattaatttattatacttcaagttttagggtacatgtgcacaacgtgcaggtttcttacatatgtatacatgtgccatgttggtgtgctacccccattaactcgtcatttaacattaagtatatctcctaatgctatcccttcccacttcccccaccccacaacaggccccggtctgtgatgttccccttcctgtgaccatgtgttcttgttgttcaattcccacctatgagtgagaacatgcagtgtttgtttttttgtccttgcgatagtttgctgagaatgatggtttccagcttcatccatgtccctacaaaggacatgaactcacccttttttatggctgcatagtattccatggtgtatatgtgccacattttcttaatccagtctatcattgttggacatttgggttggttccaagtctttgctattgtgaatagtactgcaataaacatacgtgtgcatgtgtgtttatagcagcatggtttataatcctttgggtatatacccagtaatggtatggctgggtcaaatggtaattctagttctagatccctgaggaatcgccacactgacttccacaatggttgaactagtttacagtcccaccaacagtgtcaaagtgttcctatttctccacatcctctccagcacctgtagtttcctgactttttaatgatcgccattctaactggtgtgagatggtatctcattgtggttttgatttgcatttctctgatggccagtgatgatgacattttttcatgtgtcttttggctgcataaatgtcttctttcaagaagtgtctgttcatatcttttgcccactttttgatggggttgttggtttttttcttgtaaatttgtttgagttcattgtagattctggatattagccctttgtcagatgagtagattgcaaattacagtctttaagagtgaattgaagagattgaagagaagtaacaagcaaaggagattgagaaggattggtcaatgagagaaaaggaaagccaggggaggtgctgtctcaaaaaatcaagtgaaaaaagtgttttcaggaggataaagtggcttaagacctatactgctgacaggtcaggttgcagaaggattgaacattggccactggacttaataatgtggaggtcatctataacttgacaaaagcagttttggtggaggcatatggaaacaaacagttttggtggtgtgatagcttgatggaagtggatttcatagagcataggaaaagatgaattggaaacactgggtttagtcaacactgaggaatttgctgtaaaggaatataaagaagtgtacagttgctaaaaggagaaaagggcacaaaggaacttttttttttaagagtttgttttttaagcaatcacaacaaaagcaaaaattgacaaatgggatctaattaaacttaagaacttctgcacaagagaaactatcagcagagtaaacagacaacctacagaatgggagaaaatatttgcaaactatgcatctgacaaaggtctaatatacagcatttataaggaacttaaatttacaagtgaaaaacaaacaaccccattaaaaagtgggcaaaggacatgaacagacacttctcaaaagaagacatccatatagccaacaaaaatgaaaaaaacagtatcactgatcattagagaaatgcaaatcaaaaccacaatgagacattatctcacaacagttagaatggcaatattaaaaggtcaaaaaataacagatgctggtgaggttggggagaaaaaggaacagttatacactgttgataggagtgtaaattaattcaactattgtggaaagcagtatggcaagtcctcaaagagttaaaagcaaaactatcataaaacccagcaaccttattactgggtatatactcggaggaatagaaagcattctaccatgaagacacagcacgtgaatgttgatttcagtgctattcaaaatagcaaagacatggaatcagcctaaatgcccatcaatgacagacaggataaagaaaatgtgctacatatacaccatggaatattatgcagccataaaaagaatgagatcatgtctttggcaggaacatggatggagctggagctatcatccttagcaaactaacacaggaacagaaaactcagtaccacatgttctgacttataagtggagctaaatgataagaacttatgaacaaaaagaaggaaacaacagacactgggttctaactgcggggggggatgtgggggaagggagaggaactgaaaagataactattgggtactgggcttaatacctgggtgaaaaaataatatatacaacaaacccccatgacacgtttacctatgtaacaaaacttcacatgtacctccaaacataaaagttttttaaaaagtttgtttttaaggtagaagaaataacagtatgtttatatgatgataagaatgatccaggacagacagaaacattaatgatataagagaaagaaaggaaaatttctatatttaaatagcgggaaaggatggatctagtgcacaagtagtaggatcgctgatggagggagcacagatcgttcatctatgttaacaagagaaaggcagatgtaaggatgcaggtactggtaggatgtagtggtaaaaaaaaaaaaaagtcctcaaacctccaactctccaaaaccctgctctggtaaatgatttcttgtgcattattgtacataattgtgtgatgggattgcccttgctagaacttccagtactatgttgaatagagttgtccataaacatttaggtccccacttagctattttgaataatgctgctatgaacatgagtgtgcaaatatctcttgaagatcctgctttcagttctttttttttttttttgttttttgagatggagtcttgctttgtcacccaggctggagtgcagtggcacaatttcagctcactgcaacctctgcctcccaggttcaagtgattctcctgcctcggcctgccaagtagctgagattacaggcatgcaccaccatgctcaactaattttttgtatttttagtagagatggggtttcaccatgttggccaggctggtctcaaactcctgaccttaggtgatccacctgccttgggctcccaaactgctgggactataggtgtgagccaccacacgtggccttcattcttttgaatatatacctagaaatggaatttccgaatcatatggtaattctatttttagtttttagaaaactttatactgtttgccacagcaactgcatcattttacgttccctccaacaaagcacaaagttccaattcttccctattcttaccaacacttgttattttctgctttttaaaaaataatggcaattctgccagatatggtgggtcacacctgtaattccagcactttgggaggccaaaggaagatatttcacctatagcttacatatggaaagcaaatgaaaagtatgagcctccatcaggatggaagtggggggaatactccaagcacagcctctaactgtggtcctgcagtactttggtttacataggagtatatgtgtgtgtgtgtgtttgatcaatcccaaatcactgttttgctctctactcctgccattttctcaattcctctgcattccaaatgtgttacacgggaacttcggttttttttttttttttttttgaaggagtttcactcttgtcactgaagctggcatccagtggtgcaatctcagctcactgcaacctctgcctcctgggttaaagcaattctcctgcctcagcctcctgagtagctgggattacaggcacctgccaccacacctggctaattttttgtatttttagtagagatggagtctcaccatgttagtcaggctggtcttgaactcctgatctcaggtgatccacccacctcagcctcccaaagtgctggattacaggcgtgagccactgtgcctggcccgggtttttaattttttaaatttaattcaatttaatttaattttaggttccaggatacatgtgcagaacgtgcaggtttgttacataggtaaacatgtgccatggtggtttgctgcacctgtcaacctatcaactaggtattaagccctgcatgcattagctatttgtcctgatgctctccctccccccacacccccaataagacccagtgtgtgttgtttccctccctgtgtccatgtgttctcattgttcagctcctgcttatgagtgagaacatgtggtgtttggttttctgttcctgtgttagtttgctggggatgatggctttcagcttcatccacgttcctgcaaagtatattatttcattcctttttatggctacgtagtattccatggtgatatgtgccacattttctttatccagtctatcattgatgggcatttgggttgattccatgtctttgctattgtgaatagtgctgcattaaatatatgtgtgcatgtacctttatagtagaacgatttatattcctttggatatatacccagtaataggattgctgggtcaaatggtatttctggttcaagatccttgaagaattgtcacactgtcttccatagtgtttgaactaatttacattcccatcaacagcgtaaaagtgttcctatttccccacagcctcgcaagcatctgttgtttcttgactttataataatggccattctgactggtgtgagatggtatcttattgtggttttgatttgcaggaggttgaggctgcagtgagctataatcacaccactgcactagagtctgggtgacagagtgagaccttgtctttattttttgactcttttactttcagtttttgtgtgtccttaaatctaaagtgagcctcttgtaagcagcatattgtttgatcttttttttaaaaaaaatttatccagccactctgtgtctttttattggggaatttaatccatttacatttaaataattactaataaggcaggacttactatgatcattttgttgttttgtgtatatattatagttattttgtctctttttactccattcctgccttccttttgtgtttcattgattttgtcagtgacatactttgatacgtttctcattttcttttatgtatcttccatgcatattttctttgtggttaccatggatattatataaaacatcttaattatatcaatccattttaaagtgataacaatttaacttcaattacatacaaagctgtactctttcacatcccaccaccacccactttgtgtcattgatgtcataaattacacctttttattttttgtattcattaacatggtgtcctagtccatttgggctactataataaaataccatagattgagtggcttataaacaacaaaaacatatttctcacaattttggagtctgggaagtctgagatcaaggcctggcagattctgtgtctggtgatgggccacttccaggttcatagactgctgtcttcttattgtgtctttaagtagtagaagggaatttggacttgctccaaattacaccaccaccctttttggctctccaatttgtggacagcagattgccagcctgaataatcatgtgatatgattcctaaaaccattcaatcaatcaatcaatcaatcaatcctgctagttctgtttctctggaaagccctaatacatgcagttttatatagatttttaaaaatgcttttatgttttgaattctataccagaatttaaagtgatttatatgccaccattacaaaattacaggatgctatatttgtctatatatttacctttactagagagctctatattttcatatgctttcatgttgctgtctggtatcacattcttttttttcatcttgaaaaactccatttagcatttcttttaacgtagatatagtggtgccaacctctgttaacttttgctttttggagaaggtctttgtttctctttcattttttttaagaataattttgctggttatagtatttgtggttgacagttttttttttttctcctcagtactttgaatatataatctccttcccttctgtcttgcaatgtttctgctgggaaatctgttgataatcttatgaaaccttccctgtatgtttcaagctgcttttttcttgctgttttcaagattttttctttttctttgtcttttgacaatttgattataacatacctctgtactgtcctctttggagtcatcatagttggagtcttctgagctttctgaatttggatgttcacttccttcctcatatttgggaagttttcagtgactattttttcaaataagctctaaccatttctctttcttttctccttctgtaatttccataatgtgtatgttgattcatattatcatgtttcataagactcttaggctttcccctcacttttcttcttttcttttaaaatgacttttaaaattcactgattttttttctgttttctctagtttatcattgaacctcgctaatgatttttttaaaaattcagttattgtgttcaagtccagaatttctatctagttctttcttattgtttcaatttctttcttcgtattgtcattttgttcacacatcgtttttgtgatccctttggttgcttctctgtgtttcttgtaattcattgagcttctttaagatgactattttgaattctttttcaggtgattgatacatctctgtttcttttagagtcatgcatcccaagcagttgggatgccataactaaatgccgcagactgggtggctaaaacaacaaaaatttattccctcacattctggaggctgagatatttaatattaaggtgccagccaatttggtttctattgaggtcctcttcctggcttgcagatgtccaccttcttgctgtgtccttacatggtagagagggagaaagaaagaaagacagactctctggtgtttcttcttataagaacactagtcctgtaggaatggggtcccatccttttggactcatttaactttaatttcctttttataggaaattactcagatataggatctgagtaccatcagactaggtattagggcttcaacatacgaagtttgggaaggacaaaattcagtctgtatcaggtcagtttttggaaatgtactttgttcctttgattgggccatgattacttgtttctttgtctgtcttgttattttagtgattaattgatagattgctggaattttttttttcgtttgagaaggaagccatctctgcaaatctttaaggactggctttgtacagggaaagaccttcactgatcagtctgactagaggttctgggggcctttctttcaaaccttttctgggtatatgtcttctttgagcttgcatgtatcttttctttcttttaaggtgttgaaaagtctctttatatatgaaacagccttggtttggtactatatcgtttatgagactgaaaatgaaattacaggacataaaatataaaaaaacctaatccatatcatgtaagaaggaagcttggcaatttaaaggacttctcatgtgctacacttgaggccacaaatatggcatgtggagaggaaattagttcaaattatgctcagattgccttgttcaagggtaacacttcttccatgagctcaattgtgaagcctggcatccaagacaggtattgatttctgtgccttcccctgctcctcctccttctccttattcttttcaatagcaggtaagcttactgtaaaatcatcggctcttttattatgtaaaacttgtgaatgctttctgatcttaaacatgagcagtaaattattaagagatattatgttctctgaagacacagaggagaaaattttgagaggttttcaggagtttgtaatttcttgcttcctctggtgtctgtcttcagtaccgcaggttctccggcacagcaaagaactgcctggctctcttgctctcagcggtgtcaaggcattcaagctatgctggttcctgctagtgcttcaagttaagcaagacagaaaacagtccctcaggtagcccctgggaaagctaaaacattggatgtatgttctactcttctcttttcctctttagaaacaagccataagttgggcactttctcctgattgagctgagctgtgctagcttgggggaagggctattatgtggatgtttttggctttgcactcttgcctgtcgtactgtaatttcttgtttctgaagttctctaaagatttttagactgtatattgttaactatgtctgttttggggactgagatttgtggcttcctattttgccatcttactgacatgagtcctgatatgcacttcttttaaggatccttttacaaagccctaccctacaacttttgcttatatctcatttcccaggatactgccacatgatacctatctgcaagggaggctgcataaagtaatttttcaaaatctgggtttgatagtaatagaaaagttaagaatttacatctggtagtctagacttcctttgctactcaatatacatccatattcattcttcctgccatatgtggaatactctctctctttaagagagacaactccaaggtctcatatattcacttcatcagctaatttagtctcatttagtcacttcataagccatggtatactgccgtgattctcaagtcatgagtaccaaatccctgaggtatatataccaagcattatcagtctactaagttatattaatcaactaataatcaattatgctataattagcccaaaaagtcatacatacatgcacaaaaaattaaatataggatgatacagttgtgataactgaaacttaaaaaattttaaatgtagtggtgcaagattctgattaatgtaatgtcctcttcattggatcctaatatggcttctgtggttcagtagcttataaaccaaaagacaagctatctgtcccaagcaccacattccccccatccccattatatgaatggagaaaaaaaccaagataatcacagtaaaaccacttattaaaggggaaaattagaaatggcatagtggacattgcccataatgatgcttgaacagtgttggacaggaacatcaaggacttactgccttagctaaaggtgaaaattcttgattaggttatctggtagaccatgattctgttatctgggagaaactctctagtctactgtcctctcttatcctctggtaggtttaaatcttgtttttattgaattacatcattacaaacaacatgcagtgaacatcatgtatcctaattaaaaattaacagatatttcccaattgtcccctaatttagtttatacccagtgatagaatatttttggagtacccctttttaatacaaagaacttcatggttgcatatattatgtaattgtagttacagtccttgttgcttaatataatacataatgacaccactgcatttaaaaacttttcaattttagttataacagtatcatcctatatttatttttttgtgcatgtatgtataagatgactttgttggctaattatgacttaattgactaattgttactaatatgacttagtaggctgataatgcttggtatatatacctcagggatttgatactcatgacttgggaatcatggaactagaccatgagcttatttagctgcagacttatgcttggccctttgcagcatttggcaccaaggtttgcacatggctggtcctctggaaatgttagttggtttgcatcccttttttgatcactatcaattgcttcaaactggggttgctttcctctcaaaatcaccatcggaaagaaatgtagattctcacaatttatcctatccttttgaaatgaggctttttgttttctaagaatcatttttgttttggtatcaacaactactgggaaataagaaaataagaaaaagataccttcactttttggctgccttcagtaattggcattaggattgggagtagcatgggtctaaaaaagctaggccagggattgctagtagaggagtaatagaaggtgttgaggactgagtggactgtatgacaattgccatgttagagtgcaagcccatttttgctacagctttcatttattcaacagcagccagaaatgtagactttatgatgcatcctattaaaatgattaaaaataaagcatgacatagcctcccccctccaaaaaaaaaaaatcaagtctctgggttgtatttggtctgtagcttctaggtttataacttctgtgcaaggaaatctttatgctttggcttgtatctcatgcctttaaagttctcgttattgtaaatagcacaccaaatgtcaggaacactttataacaaacaatatcatatcatatgaaggcttttgcctagggtgcaagagggactttattagagaagcagcagaatggtaggcaatgcattgtgaaaaagcttgctaaggattagaatttagtgcaacaaaaagatgactgtattttgacaatttttagtaaatgtatagagttgtgtagctgtcatcataatccaattttaaaacttttctcatactccccaaatatccctcgatctcacaggcaattaatcccagttccactctctttactcccaggcaactattgatctattttctgtctctttaaatttgctttttctggatatttcatatatggaataatataacatgtcatctttgtgtctggctcctttcacttagcataatatttttgagattcagtaatttttaggaataaacacttcttcgtttgttgggtgcctttgttggatttccagtgggctaaaatggttgtttgtgacagttttgtccagctttaaagctgttttttgaggaccgggttgttgagctcttctgtttatgctggaagtgaatctcctctttggcaaatcttttgattttattgattgaattttttccatctcaagaaatttaatctaaaagtttaaatagaaaatttctgaaagaaaattctggctgatttctgtcatttcatggtctttacccctttatccctggttttttgaaaatttctgtgctctttatcatcctccaattcttctcatagcctgtggctgcatccctcaggtcagttggctctccatggcatgttcaaactgtcctcagtcgtaaaagaacacatgttcttgctttctaagccatagcttatggggattctttgaggtttcctcaatctgccttcctagaagcttcacgtagccatttcaaatacactcttgtatggccctgtttgtctcacagtggggatgctctataaatctcatcctttcccaggttctacatcgaagtaatgcacatatgtttttctgccttcagaaccttagttctatttaagggtttgctgttactctttacaagtctaaaatcatccttatgtggggttggggtacaaggccctttctaagataaacactgttttacaagggacaaataactaaagattattttttagatgatttctgatttctgtattccctctatccaaagactttatgtagtttggcatggggtgttttaactatctctattttttccaagttttttaaaaatttatttcatgaatattatgccctgaatctgttggaatttagattttgatatttgaaagtttcaatttcgaaactcagaagacttttctctcaaaagtgttttctctgccatgaattttagaaagttatgttaaaacccaaaagctatgaattattttccttttcttattatctgtgatttaatccctttcttgaagtaataggcattctgcttgaggcagcggagaaacatgggataaaatgaataaatgggactgagaaataaattatttgacataggtaaacattattttactacatatatattttaagagtacaaaaagtttagtgttgaaaaatctggggattttctattctgtggcatagaacatgagataacaataacaaattatgaagtagtatatctcatattttcaaccttcatttttattctttcttgtttcctaattcgaaggtatcaaaactaaataattcatggtagttagacaataaatactgataagtaaaagtgtgtggaatgcctaccattaccagataatatttacagattacaaaaattttttgtgtataatgctatacataaaaaagaggatttcattccatctttgggaataagaggacatggggtgagagaaggcagaacaatagcagccagcaaaaagtgttttggtgcagagagattatcttgtgatttgctccgcattctatcccaacatactgcctgactcttagtctgctggcatgggtctactttatacacacatctgaagcctcttgtgcctgttatgtctaaatatacttttaaaatccacatttcaaaaagataccccttttatttctctcttcatttataaacttcacttaaaaattaataaagtcctctcactttttttcctcacaatcaaacctatcaatgggagagactgaaaaacactgtcagcacaaaagctataattcacatgtatagaaacagctaatcttttgcaggtgtataattcctctgtggaaacacaagcatactccagagatattgtgggttcagtttcaggctactataataaaatgaatatcacaataaagcaagtcacccaaagtttttggtttcccagtgcatgtaaaatttatgtttacactatattgtggcctattaaggccacaatttgtaaattacacaaagtgtaaattgtatttacactaaaatacaatgtacttaatttaaaaatgcctttttgctaaaaaatgccaacaatcccctgagccttcaatgagtcataatctttttgctggtggaaggtcttacctcaatgttgatggctgctaactgatcagaatggtggttgctgaaggttgaggtggctttgtgtgggaatttcttaaaataagacaacgaagtttatcacattgtctgactcttcctttcaagaattatttctctgtagcatgtaatgtggtttgatagcattttacccaaggtagaacttctttccaaattggagcaaatcctcccaaaccctgccattgctttatcaactaagtttatgtaatattctaactcctttgttgtcattttaacaatgtttacagaatcttcaccaggagtagattccatctcaagaaaccactttgttcgttttgttgaagcaactcctcgtctgttcaagtttcatcatgagactgcagcaattcagtcacatcttcaggcttcattttaaaattcgaattctcttgttttttcccaacacatctgcagttacttcctccactgaagtcttgaactcctcaaagtcatccatggtggttggaatcaaccttcaaactctttttaatgttgatattttgatcccctcccctgaataatgactgttcttaatgctatccagaatggtgaacactttccagaaggttttcaacttacttttcctagatccaccagaggaatcactatctatggcagctataaccttccaaaatgtatttcttgaataataagacttgaaagtcaaagttactctgagtaattattctgagatgcagaatagatgttgttagcaggtaggaaacactgatctctttgtataccttcatcagagctcttgggtgaccaaatacattgccaatgagcagtaatattttgaaaataatcttttttctagacagtggcttaaacagtgggcttaaaatattcagtcaaccatgctgtaaacagatgtgttatcatctaggctttgttccatttctcgagcacaggcagagtagattttgcataattttttaaaggccttaggattttcagactggtaaatgagtgttggcttcaacttaaagttatcatctgcattagctactaataagatagtctgtcctttgaagctttgaagccaggcattgacttctcatctgtagctatgtaagtcctagatggcatcttcttctaacagaaggctgtttcatctacattgaaaatctcttgtttagtgtagccatcttcatcaatgatcttagatagatcttctggataccttgctgaagcttatccatcaacatttgctgttttatcttgcacttttatttttggaaatggtttcgttcattaaacctcatgtacccacctctgttagcttccaacttttgttctgcagtttccttacttctctcagcctttgcagaattaaagaaagttagggccttgctctggattaggctttggctgaagggaatgttatggttggttgggtcatctatccagaccactcaaacttcgtccatatcagcaacaagtttgttttgctttcttatcatctgcattttcactggagtagcacttttaatttccttcatcttcctttgtattcaaaacttggctgtttgctgcaagaggcctggatttttggcttatcttgactttcaacataccttcccctctaagcttaataatttctagcttttgattaaaagtgagatatgtatgactctttcacttgaacacttagaggccattgtagcacttttaattggcctaatttcaatattgttgtgtctcagggaatatggggactcacagagaaggggaggtgtgagagaatggccagtgagtggagcagtccaaacgcatacaatatttatcagttaagttcaccatcttatatgggcatggtttgtggtcccccagaacaattataatagtaacatcaaagatcactaatcacagatcatcataacacatataacaataatgaaaacgtttggaacattttaagaattaccaaaatgtgacacagatacacagagtgaacatatgcagttggagaaattgtgccaatagacttgttcaactcagggttcccacaaacctttaatttctttaaaaaacccccacagtctgtaaagcataataaatcaaagtacaataatataagctatgccaataaatagaatcttctatcaagattatccacattgtagcacaaaaatgcaaaaaatgcaactcctaataatctgaaggaatgactggctttagaaaatatttacatttaatattgcaaagagaattagacctatagaagataacctgtactgtctatatcatttactatattgttgtaccttctcagcaagaggtggtactttagattcattgaatgcattcattgtttggaatttcctgagtactaatgtaaaaatacatctgacatatatattataaaatacaatgaatactattattttctaattcacataaatggtagagcctagttactttgtttatggttttacaaagacttcagcttatttagaaattgtctctcataaaaaacttgcaactaagtttattatctttcagtgcaaaatattctcaaataattaaataatttatattttaatgccctgtaaaatataatagtgactgcaaggaaacagtcttggcataacaaaaatatgtagaattttgggggtatggtcttattactcctttcagaatcaattatataacaatttggataacttagatattttcaaacttgatttcagaaactgctagttaattgaaataaagtcatctttcccatcagtttaccttaacagttttcattctatacccaggctgtgtcagagatacttgtaatacttatgtatacacagagtaggtatctataaatatttattgaagtgatgaatcaatacctgtgctggccaaatatttgtagggtaaaaatgataagtgaacactaatgttgtacttccattgcgtgagatctccccacacatcctgtggcccaatgtttgctttaaaagggaagttaaggaataatatttataataaaagtctccagattagagtcctattagtgcaacatttagaagcttagccccacatgtgttttacttcttggtgggaggctctgatctacagggtggtccagggatgcaagtacccctattttgttgcttcatcagccctgaaagcagtacttctcaaacttcaaagtgtatacaaatcccctggaaatcttgttaaaatgcaaattctgttatttcttaacaaactctaggcctaattttatctctttgctttgtcagatactttatgttttgccttaatgcaggatgaaagcctgctgaagtttaattcaatttatttactgaaaatatgaataaccaataaagtacaaatagctacatttattcctcccaatgcatagttcaatccttgggttaattataaagcataaaattgccttatttgaatgctgtgggaataattgaatgccattattgattagtgaatctcgcttgtgtgctgtccttcttcaaggcttgctagatagacttgtgtactattgcaaatccccctgtgtgatttatttattaaactgaattgttttcttccatagctcaagggatggtattttgtgggtatctttgagtccataataacccctttttcatagtctgagctgacttctaaattcattgttattccatatcctctgacttaaactgttagcgtatgctaaatgttatatcttctcagagcagaaagggaaattaaacatgaaccatagggcactcgaacaaaacacatgctactgttataaattgagtgaataaatacatactgaaacatctcccagtgtagtctattaagagtctttggtttatttaactccatatatttttgttatgccaaatcagatttttttaaaaaggtagaacttccaccatcaaaggcatttttaaccagataaatatgttatagtggaagagtgaccactgcacagaggttttaagagctggccatctagatgacagggtgacaattgcctttaagcaaatgattgattgtaatgcaatagactcatttgtaaaggtaaaaacttgcaattggcctctattataggaactcaattattgaatttacagagatatcttttaggcctcttttacatttccttatctataaaatgggctccatgtgagttcactacctgaatgtccaactagaattaaaatgggcccggggtggtggctcatgcctgtaatcctgatactttgggaggctgaggaaggtggattgcttgagctcagagttcaaaaccagcctgggcaacatggtgaaaccctatctctgccaaaaatacaaaaattagccgggcatggtagtgtgtgcttatggtcccagctgctcgggaggctgagataggagggacgctggaaccagggaagtcaaggctgcactgagtcatgatgacgccactgcactccagcctgggtgacagagtgagaccctggctcaaaaaataaataaataagaataaaaataaaaatagattaaatacatacataaaattagaccattatgtgaatatgatgaaattcatggaacttcttcaagaaaaatgcacacatataaatatgctcaagttttttttttgctgtattttatttcagattcagggggtacatgtgcaggtttgatacatggatatattgtataatggtgagattttggcttctagtgtacccaacacccagatagtgaagattgttcccaataggtaagttttcaatcttcattcctcaccagcttctcccctttttgagatctttgtgtctactattttgatctttatgtccatgtgtacccatagttcagctcccacttatgagtgagaacatgtggtatttgattttaaattgatattctgattcactagatttgacatggaacccaagaatttttatatctaagaagctcttagattatactggtgctgctgctgttctcagtacaagcggagcagcaagattatacagtggtatctactgacaagtgaaaaaaatgttaccagaatattcctatatagaaaaaactattctaaaagttacataaattatcaaccatttctttaagagatatgtaatacaaatatgtcgtatatattcatatataggtatataatatttatatgcactgtaagttgacataagcatagtttgtgtgcatggctatctcctcaaatctattcttcctctccaacttggttttcattttgtattcctgatgcagttgagaattctaagagctttggaagaagttgtcaatcttctctcctcacttttttcggtttggtaaatatacatttgaatctgtcttttccttctggtaggcaagatcagtcaggttttggtctggattgaaattcaactttagcaaacaatacaaaagtgaaggatatgccttaaaatactggcagtgactgtggtaagatagtgtggttggggtgtttccattgaacttgtatacacttttccattttggagacaatatatcacttctataacataaaatatcttactatctatgtatgaaaatggcttttcttattggaggcaaatattgcctgatttactgaaaattctaaaaggtgtgtaacccttgatttgtttctgtatatggttacctttgtcttttcgtgtagtaccttcctcagttaaaaacatgccaaaaaacaatacttttccctctagttaatagcaccacatcaaatttccccattgttaggggagatgatgggcaacggggccagctgagttacagctatgtacagaatgaatgagtgaatgatcacatcttagctgacgggtggagtacagcttggcaatctggaagtgggtgacacttgaacatacaggcttggagatatttggtgtcaagaaataatttgataccattgattctaattcctgggctagaggtcaggatcagaactcttatatgtgagtaaggcccaggaaagaataagtttcagggttccagttttgaagatgctgtcgttctgggtatttttggaatcagggattcccattcacttactatgcagaccttccaaacaaggtaaatcttttcagtatctaattccagtgaaaatactgttaggaagcagttacggggcaaaaaaggaaacaagggaatactctagtaattcaaaacttcaaatgtaagattggggctggaccagagtgagggtgatggatactgaatcttgagtattgggttggtgtttcttaaattctacctgttggatttgattttagaatttcctgcttggggtgaggatggtggtgagaggtttgtgcttgcagaaaggaggaagtgtgaagttagatgcagagactgaaaatgaattaggtttgtgtttttcagtatagtactaaaaccacctgcatttggatcattttgactgcttactaaaaatgcagattttcagactaagtgattaagtgtatgtcaaggaatctgcatggttgtgaagtacctcaactgtgataagaaccacacatttcacagagcaaagacatgccctcaagatgagcctctgtctcagaatgtcttttgctttcagctctgctgatactcccatcctttgttattcagctcaaatgctatccctgttgcaaagctattctcaatcttcctagatgaaatatatcaagtagtcactgatgctttcatggtactttactgtgttttgaataagtaaatatccttaaaataccattatttgtacgtatggctctacttgcattggggcagtgcaatgtatcacagtggtcagtcagccgggatttaaggctcaggtccacctttcatctactgtataactttcatcaattgtttacttttaaaaaacgctttacttttttatctgtaaaacagaggtagttgtgaaaattaaatgaattaatgtaaataaagcacttaacagtgcgtggcacattgtgtatgctcaagaaacttttgttattattatcttctagggtaataaggcaccttatattatttttttgtcaagcaccctgtgaaaaagtaggcactcaagagaattgattaagttgaatgaaatttatctcataagacatgtataagcccagagggacaacatccaagggggaaagacacacttggttctctggaagaaatacatgaaaacgcacaatgtaatatttatggttttgaatttgagagtgtgacggtgaggagatttaatttaaagataccataaagagaaactagggtgaaagaattgccagagttttcaaaacacatcctatagtatatttgatatgctgccatgtatgtcttatagaaaataattgctactagctaaatgacctatacccttcctgactcttttaaaagcagaatgctggtttagaagcataccatgaaagcaaattcagaactatcaggcaatgtctcacttcctatttggcttttaggattctggtgtatgggagctcaattttcaagtaacagacatttactaattaataataaaagtagtaaggaaagtaaatataggatatatgggctttgtttgataataagatttgttagtatataaattcaaggaaaattttaattatgttttctacttaattacttatatttttgcctttttccacaaaagacttatggtccctatttagctattttgataaaaagcagttttttccaagctcttaaaatttagaatcaaaaaaatttctgtaagtggatccatttatatcttccataatcctgctactcatagcttagcaaaattccttactttaaaaaattaggtttattgcaacttgtcaaagagctgaatatgaaataaatctcatataattttatattatgtatctagacatgtttttaataaaaaacaaaggctattattttctttttttaaaactttaaagttcaagggtgtatgtgcacttttgttgcataagtaaatttatgtcatgggggtttgttgtgcagattatttcattacccagttattaagcctagtacccactagttattttttgtgatcctctccctcctcccatccttcactatctgacaggcctactttgtgttgttcccctccgtgtgtctgtgtgttctcatcatttagctcccacttataagtgagaatatgtggtatttggttttctgtgcctgagttagtttgctaatgataatggcctccatctccatccatgtcccagtgaagaacgtgatctcattttttatggctgcatagtattccatggtgtatatgtaccacattttctttagccagtttatcatggatgggcatttaggttgattccaggtcttcgttattgtgcatagtgttgcaataaacatacatgtgcatgtctttataatagaacaatgtatagtcctttgtatatactcagtaatgggattgttgggtcgaatggtatttctgtctttaggtctttgaggaatcaccacactgtcttctacaatggctgaactaatttacacttccaccaacagggtataaatgtttctttttctctacagtcttgccagcatctgttattttttaactttttagtaatagccatttggactggtataagatgatatctcattgtggttttgatttgcatttctctaatgatcagtgatgttgagctttatttcatatgattgttggccgcatgtatgtctttattttcaatgataaaaatacatatgactttattgatcaagagttagtgaacagtttcaaggaaccattggataatactgctttgttggtgtgtagtgtgagctggaggaaatgatcatttcaaaatttgtaaaagatttctatgttatttaaaatattctttttgtgtcatggctgatattctctgtttaacaaacgttgagagtaaaagcacttgcattcctacaataaaatattattttcagattaaatgttaagacttcaggacacaagtgtagtaaaatgggctaataaaaccatattaaagtttgagcctatgcagcagtatgcaggcacagatggccttggctggtacagaggctccaccttgtattttctaggcctgctgtgttttcagacaaagatctccaaaggcaaagggttttcttcagaaaaatctcaaagccatgtctctgtaaaacaccagtatctctacttccagtttacagtcatgatggagtaatggggaccagatttactctcctgcctaaaacaattttaaaagtagccaaaaatggaagaaacattttcaccttggcagtaggtaataaaaaggaaataaataagatgagcttttgattctccagtttactgcctggagagagtttacaggctgcagagcaggaaaagcaagctcatactgagcctggagaggtttttgagttgagaaaacagagttaagaagtttcaagatatcaaggcagctaaaagccatgcaatagggtactggggatgagggagttgcacagaggtataattctagcaatctgccaaagattcctccttgagtgttcagatgagtactgaacagtgcttatatatgatgaaattacccaacactggaaaagaatcacaggcaaggagctagtagaagaatccctgatggttacagagttgggaataggttgtatcttaccagccacagaagaaaaatacatggatattagtcagaatactcagaagggtaatgcttcagtaatggggcaaaattagctctgcaccaatggccacagtcttgcctaatgaagcctaaaagaaaacctcaaagggatgaaacattccaaccaatttaacaatgttacagaaaaaaaactcagtaatatgaaaatatccagcacccaaaaggtaaaattcataatgtctgacttgcaaagaatcagaaaaaataggactcatcacaaagagaaaaataatcaattgaaagagatctgtaaatggcacagatgatggaagtagtagacaaggacattaaaaccctgttacaactctactccatatgctcaagaaagtagaggaaagcatgagtatgatggtaaggaaattaaaagatgtgaaaaaagacccgaataaaattctagagatgaaaaatacgaggtttgaaatgtatgcattgaattaacagtagattagatactgcagaacaaaagacttatgagtttgaagaaattgcaatagaaacaatgcgaaatgaaacacagtgagaaagagtggggaaaaaatgaaaagagtatcagtaagccttagaaaaacttcaggtggcctaatacatgggaaattagaatcctcaaaagagaggtgagagggactaggatggaaaaaaatatttgtagaaataatggctgaacacttcttcaaaattgataaaagctaacctacagatccaagaagcttaacaagttctacatgtaagaaatatgaagaatatttaccccaggcacatcataatcaaaatgcctaatagtagtgataaaataaaaataggaaaaatagctgggtgggacagaatacattatgtatagagaaatgaagtaaaaaataatagtgacttttttttcagaaacaatgcagagtagaagacaatgagtgtagggagtgacatatttaaagtactgaaagaaaaaaattttaaaaacctgtcaacttaaatatataacccagcaaaaaatattttaaaaacaagataaaaatagatacatttttagatgtataaaagctgaaaaaatttaacatcgtcagatttacactacatgaaatgttaaaatgttgcttcacaggcaagaggaaaaaagtaccagaagtaactgaattgacacaaataaacgaagagctactgaaatggtgaatatgtgggtaaatataaaggacagaaacaaaactctcaaatgctgctattggaaatataaaatagtacgataactttggtaaacagtttggcagtcattttgttaaattacccatcacttaccatatatataaaccattcattctattactgggtgtttactcaatagaaaagaaataagacttttaaattattatttataatatttttattcaagataactgaaaactagaaacaacccatacaactatcaacaggtaaaggaagaaacaaattttgtgatgcgtccatataatgaaattgaatactactacagtataagtatcaatatgtttcaaacaacagtaataaaaagcaataaattattgataaatgcaataaaatggatgaatctcaaaatttgtttctgcctcatataggctaaatgggatgcatactttatgatcctatttatataaaattctataaaatgtaaactaatctaaaatgacaagaagcagattagtgtttgaggatttggagttcagagaaagggctgaattacaatgggacaagaagaaacttttggggttgatatatgtattatatgtattcattatcttgattgtgcagatggcttaataggtatgtcaacatcaaaatttgttaaagtgtacactttataagaagttttattgtgtaataatcatacctcagaaaagctataaaaatttatattaaatatatctacttttacctttttctgtcacacacgggtttatcactcacataacaagtacatggtaggataaaagagagataataccactaactatcatatgtgcagttctgcttcatcaaagatctcagtgtgcttttacattcattactaaatgtagtacatgccttagccagaatgtgattcagatgtgtggccatattaggccagttagcatggtgggccaattatcattgcattcacatgaagattgagaaggatgttgcaaagttcatcctgaaggaaggaggaagcagacatgataagcttgatctagcaagaaaatcttaatgagtctctgagagtcagggacaatgaagaaaacatgccagggtgtctcattcctgtctgtattattcagcactggctgctataacaaaagatcaaagactgcgtggcttcaacaacagaaatttgtttattatggttctggaggctgggaagtttaagatcaaggtgatagcaaggtagatttcattctgaagcctcttctcttggcttgtagggtactgccatctcactgtatgctcgcatgaccttttttctttctttctttctctctctttctttctctctctctctctctctctttcttttctttctttctttctttctttctttctttctttctttctttctttctttctttctttctttctttctctttctttctccttccttccctccctccttccttccttccttctttctttttttttctttttcgagatgaagtctcactctgttgcttaggctggagtgcagtagcaccatctcagctcactgtaacttccgcttcctacattcaagtgattctcctgcctcagcctcctgagtagctgggactacaggcacgtgccaccacatccggctaattttttggtattattagaagagacagggtttcaccatgttgaccaggctggtctcaaactcctgactcaagtgatctgcccaccttggcctctcaaagtgtggggattacagtcgtgagccactgtacacagtctcacatgaccttttctttgtgtgtgtgtggaaagaaagagtgagtgagcgagagagatctctagtgtctcctcctctgcttctaaggatatcagttctattgcattggggccctaccctattacctcatttaatcttaatgacctctttgaaggccccttctccaaatacagtcacattgggagttagagcttcaacatatgaatttgtgagggtcatgggggacacaattcagtccatagcaccttctgtaattggactgctgcagatagaagcaatttgaatagcattttccttccttcctttgttccttccttccttccttccttctttcctccctccttccttccctccctcccttcctcctccctgccttcctgccttccgggcttccttccttttcttctgacttaatcatcaacactgaaggaataatatatgtgagacactcttctaaatgttaaagataaagaagtaaataacttaaagtccttgatctcactaagcttacaatgagagaggacaagaaataatataaaaaatccaaatggatgtgtaaaagaaagtcttataagtataaatgccagtaagaagtgaagcagaataaaggaatagagggtgatggggcagagcagtgtagatatataagactggaataatcagtaaatgtcacttagctaatctttgaggagaaccctcataaagggagggaagaagtcaggccagagggtgttattaaacagagactagtcagtgctaaggtcctgagggtgaagttttattggtgtgtttgaagaacaacaaaggggccagtgaagagagcaaattgaaaagtagttggagaataatgtgaagatataataaagtccaggtgatatagaaattataagaaatgttaagaatttggatttggttccaattatcatcagaaatcattagcattttgcatagaaaaagggctcagtgtgagtcatattttagaaaaatcattcagtcttttgtagagaacaaagcaatggcagcaaaattggaagtaataagactagttagaaggctattaaagtaattttagacaagacataattgccgattttactagatgggagccatgagtacggtaataactgggatttggaatgtattttgatggtagacccaccacccttaatgatggataggatgtgtgttatgaggtaaacataatagcaaaggcaacttttaatttttgttctgaggtactgagtgaattgtggtgtcatttactaaggtgggggaacattaagagagaagcaagccttaggagaaaaatcaaagtaatgtttggaagctgttaggttatggatatgtaatagatattaaagtagtcagttggatatatgagtctgaagctcaggggtgatgaagaaattggagatataaatttgggagttataatgaagagatagtatttaatgtgatgaaacttgatggtatcactacagtaggcatctagtcagaaaaacagaaacagggtactcagcagaggatatttaatttaggcaactggttgtacaagtgttaaaggctgaaagaacaaaatgggagcatcaaggtactctataggtgatcactgcaagaagaagttgccaacagataggaatgagagaagaaaaagggggaaatagggttttggggaagaaattcctcagataatgttcaaaccaccaagaatggagtccagcctggctgctgttactacaactaaaggacacaacgaggctagttgaggggatcctgaaataatccagcactccaacatttaaaggttgggaagaggtgaatctgcaagatgattcaggataaatagtctatgaggtagaaggaaagtaggagagggtaaactcctagaagctaagtggggaaaaaaagactttcaaaaaggaggaagtatcatgtcaaatactgtttaatggtcacataaaagttggtcacataagttggaaactgaaaattaactattggatttgataaaatggaagtcgttgattgccttgacaacagtggatgcataagggttatggggataaagtctagctgaggtgaattcaagtaagagtagaaaatatggcagtgagtatatggaaataagtttttcagggaattttgtaataagttggagaaaggaagtagggcaatagtaaaaaaaaaacatgtgaaggtaaggttttttgtttttcttttaatgtcagatatgacaaattcatttgttgttgaaaaaaataattgagagggaaaaggttgattacaagagagagaaaagggtaattgccagagcaaaatccttgagtcactgggagataaaggatatagtatacatgttgagggattgagcattcatttacttcaacaagaaagaattcggggactatgggtacagacaatggagggttggctgattttgtagtaggaagatgaggaagttctcttgattatttctgttttctgagggcattacaatgtaccgcagtcttctaaaagttaagaagagggggtgaatgaggtttgggaaactgtaaaattgtaattttgaggcagagctcacttgaagttagtagttctatctgtggaaaaagttgaggttgtggaacctgtatcattctagatacagaaaattaggcataaactgtacgtaaaaatttaaaaataataaaccaattaaaacttggttgttttttactatcactgtgtttaagcattctaaacaatgtcaatgataaagcactcctccctgaaaagaatcttttattcatctaaatcctaatataaacaatcgctatgattacttttgagttttaacagtacatatttaagttcattttagcacatgaaaatgtgctgaattgctagatgtatttaatatttaataaatattgtagtttatatggaagctattttggaaaacttgtattttaaaaattggcccctgcgctctaacacaggcagacttagcttcactggttcctttagtattctaaaatggtatcattcaagcttgcttcaggcaagttcacatctatatgtattcctgtgtttagtagatttgaagtaaacaatagcccagtgattgtaaagacaacagaacttgagttatttcaattccgtctctctctgtgaccccttggagtttttagtagtgtttaaaatttacaacagtggaacagagttcaaattgcaagttgttttagttttgttgaagaattcaacttttagttcatccataaaatagattaattctcagtcataatattacggaacataattttgttatatggaggaagagaatgtggtaaaacatgacccattcctggtgtcgatatgccacgtgcaacattggttgtcatgaatcttaaactcaactagcatgtttatatgtccacccaactcaacaaaatgtttagctgtagagtcaccccacatcctactccctaccattcaggggctttgaggtagaggacaacatgccataggcagagtggaatatgagaagtcagttcataaacatatttgagacactgagaatttaaaggaagtggggaccaaaattctatataatggatttgggagaagtgagcaaatacattctaaattgctactgttaatttgcttttgcttgtacctctaggccagtcaaggttggaaaacttgggttatatttatttgtgccatatactatttgtgccgttatcctatttttctttgaggtgtacaatggagtaggtaaaatgtttaaatatatctgattaacaaaattgataaatgagattttaactcagacttacatattttctatttggtgttttatacactaaaataggtcaaaatacatggtatgtagaaactatgaaataaacttattttattgtactcagtactaattagatgctcattgctgtcatctgaatgttcatatccttccaaaattcatgttgaaacttagtcttcaatgtaatactattaagaggcatggccttgagaggtgagcttagttatttttactacaaaattaaaacaactattagtacccaggattagtttccttaatttgtaaaaactttattaaagttaggtaggaaacccaaagttatacagcagtagaaaataataaaggcaaaaatgggattctataggtgagctaacagacttcaataagaatcaactttccactttcattgcattggatgtgtagacattttctactgtacttctaatcaagggcattcatagagataagctacgagtttgccagagagatcggccagaagctactccaggcagcaacatgtaaggaagatatcctgtcagagatttagtgagactggttccacctataggttctgattgtagccagccatgttggcttacttacctttttgattctgcagtaaaaatcttatttaaaataatagtcttgcttctcctattctctagggagaccttgacagaaagttctatgcttaggttagagcgctaatgggaagacagtgactgcccctcctccctttcagctgccctcccattctccaggaacacagtcaaggcaagttgggtggtagtgctggtggccaagggagccctgtgagctggtactacaggaagcgacaagcacaggaaaattcagtgggaagacacaattctgggtcctctctcaaggatactacaccatagagggtgtgagtagctaggtcttaaggagacaaggaagtgattacaaacatatcattccccaagcatatctcagactaaaagaaaattgcagtggtggcatcattttgtttgtgggtgcagctatcatttgctaaattggagacatttgacttcggctcttaagaattgtactgttgtttatagaaacaaatcttacatttaaaacttaaaataaaataaaccagattttgatcttccttacataatccaattttcaaaaaacagcaaataacaacttttttccaaactgaaatttgaagcatatgtgttggtgagcacctgttctagaagcagcatgtatctacttgacctaattccattctgtatgtcagcctgcaatgcaataggaagtccatagagaagataaacagaaaggttagtgtgcagtctccctctgccactaggaaataaatggcagaagagtcagtcaatcctgtaagtttccactattttccattttttagctagaaggaaagggagcaatgtaatcaagcagagaccagagagcaaaaataaaaaataaaaagaataatcaaatatctcaaatatccaaagcaatcttgagcaaacacaacaaaactagaggcaacacactacctatttctgaatatactacaaagctgttgttatcaaaacatcatggtactgtcattaaaagcagacagatagacaaatgtaacagaatggagaacccaaaaatgaatatgcacatttatggtcaattgattttcgacatagatgccaagaacataaaaggaggaaaggaaagtctcttcaatcagtgatgctgggaaaactggatatccatgtatataagaataaaattagacccttttgccacaccatatcataaatcaactcaaaatggattaaagacttaaatataagacctgaaattgtactattagaagaaaacacaggagagaagtttcatgagattggtctgggcaatgattttttttttttaatatgacaccaagcacaagtaacaaaagcaaaaataaacgaacagaattacaacaaactaaaaagcttctgcacagaagaggaagcaatcaatagagtaaagtgacaacctatgaaatgggagaaaatatttgcgagccgtatatctgataaaggattaatatccaaaatatataataaatgcatacaactaaacagcaagaaaacatatatatatatatataaaacaaaaaagtcaccaaggatagggaggaaaaatgggttacaaacagaaaaaaatgaacgtaactgtatttcgaatgaataatataacaccaaagttttgggatgatgggaagaaataacctaaacaacttctatatgcagtattttgattctgtgtcttcaggtgagagtaacaactattgtactcaagttggtagatttgttcttaccatgatatggattagcggtttctaagtttgggaaagaaaatgtttagcagctggtctgtgatcaacttatctgtcattaccaggaaggaaagaaataaataaataagatctaatctcttggcaaacatgttgataagagatgtatggtttatctatggaatctatggaatgatttaacaagaagtctctggttaatgattgcttatgggaaataaatctagaatctataaattgatgtggcagtgcttcctgaaaaataatctatgtaaatatttgagtataatatggcaatgtttcataaccaaaaatgctccctgctgtgtaagttaggagactattcgtagttagtaatattatacatttttccaataatggatattgaattgatatatataatgggaaaaattcgttggattctcaatataattaaaacattgggtcataaatagattccccaccatgacctatgccaaaacttgagaaacactattttactgtcttaaatttaacaatgttgatatgtttcctgtttactttatagctgattttctaggtaatatagctttgatatataagcctctgtaattataaaattgttaaccaaaaatgtaatgatgtctaagatgtgagttgctggctcacagttaagcattctaaaggagaactaaagtcacggatctccaacctgttacacattagaattgcctgaaacattttggaagctatactgataaccaaaattttaattatctttttttgtattaaaaattattccaacacttagtggtttaaaacaatgccgatttgtatcttacaattttacaggtacagaatcaagcaagaattggctaggtgattcttctgctacacctggctaggcttggccgaagctcagggacagctcctctcatatgcctggtaccttgtggatatctggaaaactgaattcatcaaggcccctttccctcagtatgtattctcaaacctttctatagtgtctctccagcaggctaattaaagcctcttaaatggaggttcagggctccaaatgctagtgtttcaaaagtcctagaaagtagtagaagactttctgtgacatagccacagaagtcccagaagattactctgccacaattaaataagtcactaaggctggcccagattcaaggggaggacaattacactctatggcacaaaaggagtagcaaagaatttgcaacgtctttaatctactacataggcatcacctgagaccaattaagtcagaatctctaaggatggagtttcgcatcagtatcgttttaaagctctttgattctaatttgcacctaaggctgagaattcctgaactaaagtaaatggcactagtaatttccaagtcattattccatttaacttctaaaaatagtttatttcctatttttgcaaagcagccaccctgatgaaaacgaataatgtgtgcaacacttgagctacattaatttttatacacacaaaaaaatgttgctaatccaacctcaggagacaggactatttaagataatttttcaacatttgtgaaagatttgtgttgatttatgccatctttgctttccaggtgtttcttataagggatttgactcattagcagttttctaatcagttaagatgtttacaaatatattaatctcatctgtaaccaccctccttgaggaaccaatccatgttgccaaattccatagcttttcaaaatccgcactatttactttttcaattctatccccctcactactcatcgagcactttgcattccattcacaatgaactctccactatcactttgcaaggttcaaatatctctatatatgcatttacccaatattctgaatgtcctccacatccagcttctatgacctcaacctctataccaaccatctgttgatgcatgctttaaaattaagatcaacatattttaaatgtgtgatgcaaaatactacactgtcctagaagaaaccaaattagtttttgaagtcagagaatacttcctaagtaattggtatttaaggtgagttctgagagataagtggtgatttaccagactataacagaggccaaaatatcagcatcttagacaaaagtttacttctcggtcacatagcaaactaagcataagcaatccaagactgatctgttggcttcatgaaactaggaacacaggcttctttttgcttgttgctgtgctgtgttcaagaagtagcttttatctcattgtctatgatgactcttgcagcccctacatcttgtttcaagctggaggtgaggagagaagtggaggtcatactcctccccttttatgactaccacctggaaattgcacacctcacttctacttacatcctattgtctagaacctagtcacaaggccttttgtagttcccatacaaaagatactgggaaataaagtatttagctgggaggccaggtgcccaggtaaagctctagagttctatttaataaaggaagaagcagagagggacaaccaacagaatgtgaaaagtctctgacaaaagaaagaatatggtgaatcataggaactgagaaaaatccagtaagggatcagtcacaggtgtgatgacaatagagcaagcagcaacagacaacagaatctcacggaactgattccaactcttgatttctaacttgttaagttttctggtttgaaatttcaattatcttccagtcctgaagtccaggctcgaatcccagttaccttccccatgataaatgtcctgcctctaccccaatctggcagttaagcttcactttattgataaatcaccggttataacccaattttgcatctggcatccctggatatcattattcttacctggcctcctgacgccacctaatccacctgattaggaaaattttcggagaaggagttgtggcctaggagaatatattgaaaattgctatctacatattactccatttgagttacactggctatccataattcagggcaatggatttagagttgtaaatagactaattatcacccacattttaacatcccattacataagatcaagaatcagcatagagaattccataccctggctcatgcctctctactaaaaatgtgctgtaggtgctgcttgacttttagaactaaagatgggtaattctaagaaaacaataattacagaaagatcttccaggtgatcagattgaaagaatcataaataacatccaagtttggttatattttgaagaaaattatccatgattcctcaacatagaaataaccagtattttggtatattttcttctaacctatttaggttagaaggcatgctttttttacataagtaaaatcatgcctcatgtatatttttgtatacagatttttttaaagcattttctcatatcttaaaagattctgaggatatctttgaggtgcacataggaacctatctttttaatatgctttaacttattaatctgtttcttgattattggacactgatgcagtttcagtgcttttattgaaattcatactctaataatcattcatctttggatataaatctgtataaaacaatgttcctaattgtttgctggaattgttgggtttaatgaataatacatttcatttttaaaggttttatcagtttatacccaaataaaaagtatataaagtgaatttttcattatgacttcatcactattacttttgtaaatagttcctaattagatgggtaaaaaataatatcccattgtcttaatttacatattttatgttggtaatgagattaggcttttgggggtttttaatatatttaagggttatatatgtgtttgatctatgagctgtatatttgatacccatcttttaggctggaccttgcaggtggtggggttctttgagagctatttattttgtcatcttttgttgcaaatatggctgagtttctaatttccattttaattgggtttatggggcttttaatatgaagaaattgttaactactgtgtggccaagcctatgaatttttatctttgtgatttttttcatttgctttagcaaatctttttccatttggaaataagtattacttatatattatgtagaatttaaaaaatcgtttttttatttttaattaatttttacttaaaattgacacaaaataattgtacatatttatggggtatagtgggatgtttcaatgcatgcatacattgtataatgataaaatcagggtaattaccatatctataattttaaacatttatcatttattcctggtaacaacattcacaatcttttagctattttgaaataaatactacactgttatttgctgtagtcaccctactgtgtaatagaacaccagaacttattcttcctgtttagttgtgactttgtactcctttatactcaatgaccaacctctcccagtccgccttcctctctatcttccctagtctctggtaaccaccattctattctgttcttctatgaaatcaactttttagattcaacatgactgagatcatgtgatgtttgtctttctgtgcctggcttatttcacttaacatagtgtcttccaggttcaaccatgttgccacaaatgagaggatttcattctgttttatggatgaatagtatttgattttgtgtgtatatatacatctacagataaatggataatgaaatgttatgcacacacaacacacacacacacacacacacacacacatatatatatgtataaaacatttctttatctgtagattgtcatttaagttgatttcatatcttggctattgtgaatagcactgcaataaacagagtgtagatatctcttggtcatatgatttcttttcctttggacatatatccagtactgaaattgctggatcatatggtagttctatttttaattttttgaggaccttccatgctatttttcataatggctggagtaatgtacatttttaccagtaatatataagagttctcttttctccatatccttgccagtatttgttattttttgtctttttgataacaagcattctaatttgggtgatgcggtatcttgctatggttttgatttgcattccctttttagcatttaactctgatacacctgcaatttacttctggtgaatgtggaagttgatttttggcatcaattcagttttcaatttcaattttccccttggctaatgtaatttttaatgtacataagcagtaagaaaatattattgcctcaaaattatagaactgataaggtagactttgaaagcaatgacacaagctaaggcagagtgaaagaccttgaagatctctcaggaaagcttagccatcaccaataaaaagtattggttggggctgttgtttagggagttttaaagtccaggcctggagcacattatgctaagtaggataagccagacacagaaagataaatactgcaagatctcaattatttgcagcaactaagaatgtcaaattcatagaagtggagagtagaatggtagttaccagggctgggagtggaggaaatgagatgttggttaacggtcacaaagttttgttatgtgagatgagtacgttcaagagatctaatgtacagcatggttgactatagttaataataccatgtgatatacttgaagtttgctaagagagcagatctttagtattcttaccacacatacaaaaaggtaaccaagtaaggagatagatacgttaattagcttgactatagtaatcattactccatgtttacgtataccaaaacatcacattgtacacttgatacatacacaatttttatttataaaaataaaaattaaataaactattaagtccatctattccccaaggggatcacaaaacatagagctgctttatatgaaaactacatgttctattaatttgaactattttagatgtaggagtctgaactatgtcacaaagttgcttcaattttctaattcacttagtctgtataaatgcagcttgagaacagtccctggcttctctatgctagtggtttatgctagtggcatggcaagataaagatgatcatttattgctagtacttctaggcataatttcacaataacaactatgaaaggaataaaagcaaacagaaataaatatttctctccctatgccctataaaaattgtacctattgcaaaatggatgcctaaaatacattcagggaagaaaccacatgaattattcttaacccagaaagaaagctatccataaaggggaatattcccttctttttaacctgtgttactttgtgataataacctcaaaattccaattttgtctttactggattaaaagaacagcaagtcttaagacaagtttaaaagcagaacctcaaacagtattcttgtaaaaataatttattgttggaggtcaaaaggggacttatgggagtccctagcaggcagaaaagctaagctaggagatggtcttggctggagacgagcttcagtctgattccattggaagctcaagggcgtgaatttcacaacagagctgctgccaacttgaggtaagggagccagtcattggctgtgggctaggtagcagctgtgatccctttaaacagtcacctacgtatgtaggagccacaaaatgggacaacagcaccccactgccactaccacagcctcctagccacactcacttttccctgggcctggaaagtcctccctttcctaactcccatgttatctactaagtgaagtcttttccaacctcctacaaacatccccaactcccttgctctttttgtgtgtgatctcgctatactcttttgtaatatttatgacatcatattggagcaatctgtctacatgtctttcctttcctcctgagaatgcctgaaagaaagcaattatgacatttattttcatgtgcccagtgcttgggagagtgcctaatacataactggtattcaataaatcttggtaattcaaaacttctaaatataaaaccaagagttaaattataatgctgcataactgggtatccagtgataaaatttagacagcagcaaatgcagcagaattgcctttgagtgtcttgagtgctagagtgtcaatggtggtcagactccagtacttaccctatcttagttcttttctgttgttagatccataactcagttatctgtaaggattctcaatcatctccttaaagcaatggagctgccgcactatataccccaaataatctctcactgacaaactagcagtattagaaatacctgctgctgctccataccccatggcccaattccctatgctcttcatctcaaaatttcatgagaaattcaggataccaatttatataagttagacactactgcaaaataaatcatttcaagactcagtggcttaaaacaaaaattattaattctcatgaacacatttacagataagctaaaagtcagctgatctgggcctattttggctgggagtctttgcttccagctgctggtgtacctatctcaactctttattatgggtcaatttcattttcttctccacttatgttccttctcatttgctttgtaaattgtttagcccccagcaacccccgcccccaaaacctgtacgtgtgataaggtctacaaagcagtagcatgttctagaaaaaactctgctagttgtggagtcagaaaatactttcctaaggaattggtatttaagctgaggcctgagagaaactcttagcaagaacaaaaatgaggaaagggaatactaggcatgagaaatcttattttagttaggatatggtttaacctctgaaacagagaccaaaaccacagtggtttacacaggattaaagtttatttctcaatcatgtaaccatctgggtaaaacagatcaaggctgttatgacggctccatggtaccagggatttaagcttttctcatctttttgctcagtcgtcttcaacatgcagcttccgttccatgggcaaggttacacttgtccacataaagctggtaaattgtgtgtcacagctgatatcatacttacaagaaatcctttatctgattgtttcatgtttaatataatttggatatttatccaccaaatctcatgttgaattataatccccaatgctggatctggggcctggtaggacgtgtttgaatcatgggggcagatcccttatggcttggtgctatcttcgtaatagtgagttctcgtgagatctggtcatttaaaactgtgtggcacctccccccacactctctcttgcttgctcctgctttcatcatgtgacgtgcctcgtctcccttcaccttctgctgtgagtgaaagcttccttaggcctccctagatttcaagcagatcccagcaccatgcttcctataaagcctgtggaactgtgagccaattaaacctcttttgtctataaaccacccagtctcaggtatttctttacaaggcaatacaagagcagcctaagacagtgttgctcaataataaactgcaagtacaagtacagaaactttctgctccaactacacagacttaatgcagaaacctattgcatatttcctctgcttctgctatgtctgctcttatttataatatcacaatgtggaaaagagggaatattgaaaaagtgtagttctcctggaacataaacatactcctaacttctaaattctgtctatcatttgaaattcttggggactacatggctgcatataccacgtgtcatctctagcccaacttattgtagtaaatatttcctaaataaccttctttcccccaggcaatctttatgccattattctggttcactgccttcattgcagtcatcactatttgaaactatcatgtttatttattgtattcatttgctgccagaaagtaatttccataaaacacaaattttgcttaccttgtatcactgtatatcaaatgccttggattatgccaggcataaaatgcacatttgacaagtatttgttcaatggatgatatccagggtttatgcatatggggtataattgtcagagaatgagttatgaactggcaaggtgctctacaattattgttagtatagttgagttatacaaagtagattttcaaaatacagagcaattgacttagaattgtaaagaggatatgtaattaccaactacatcttgtatccaatctcttaatatcaaaaataattaaagtttcatttccacccttgcatctctctcccaaagataagtacttattccttcccagcttagaactagaactggatgactcagaggaaacaagaaataattacaaaaaataacttcagggtgatctatattagaaaatcagaaataacgtttaggttttgaaaaaaacaggaaatgttctattttcaatttttttttttttttgcttcagagtttcaaaatatttacaagcctctaaatctagaataaagcttagttaccttgactcatgtagcagcactttcaatgtggactttttcctttttaaaaatatattttcattttaattaaaaattattatgtaaactttaaaaactcatttaaattttcaaaatagttcattttgagattattaaagaaacactgaaaaagcaaatgaaatcatccacaaccaccaaaaaaaagttacctgctattaaccttaaggcaaatttacttctaagtcttttgcaaaatgtttcatagaatcctaacttaacagaatattatttactaattttataatttttctcatgtctttaaattattttaagaatgacttcagaggctatgtaatactttatcacttgagtttatcgtaatttactaattgttgaacaagaacattgttttgatgatttgtatataaataacactgcaacaattacatttgatataaatttccaccatattgctataattttctttatagaaatgaattattaggttgatgattatataaatgagtgtttatatattgataagtattttttccttagcagttcattcattgctcaattttatattgatacataatggttgtacatatttatggagtacatacaatatgtatgtaacatgtaatgatcaagtcagggtaattgagatatctattacctcaaacatttattatttctttgtgctgggaaaatctcaaaccttgtcttctagttatttggaaaaatactataaattcttgttaattatagttgccctactgtattatcaaacactagaacttactccttctaactgtatttttgtacccattaaccagcctctccttatctccccctctgctttcccttcccagcctctggtaaccatcattcgactttttgcctccagtatgtcaacttttttagctcccacatgagtgaggatgtttgatatttgtctttctgtgtctgttttacttgacataaggtcctccaggtttatccatattgctgcaaatgacatgatttcattttttaaatggctgaataatatttcattatgtgtacgtaccacattttctttcatccattaatgggcacgggcacttagtttgattccacattttggctattgtgaatagtgctgcaataaccattggagagaagacatctcttcgacttattaatttcctttcttttagatatatatccagtggtgggattgttggatcatatggtagttccttttgtaggttttgaggaacctccatactgttttccatagtggctgggctaatttacattcccacaaacaacctatgagcgtttctctttctctgcccccttgccagtatctattttctgtcttttaaaacttttaatttttaattattatgtgtatatatttaggaggtacatgtaatgatttgatacaggcatgcaaagtgtaataatcacatcagggtaactggggtatccaccacatcaagcacttctcatttctctgtgttattttctgtcttttttgtaatagccattttaactggggtgagatgatatcttattgtggttttgatttccatttccctgatgattagtgaggatgaacagtttttcataaaccagcagttatatgagcagttttcatatactggaatcaacaggtatatgaaaaaatgtgtttcttttgaaagaagacatacaaatatttattcggatcttttgtccttttaaaaatcagattatttgtttcgcttttgagatattacagttccttatatattctggttattaatctcttgttgaatctatagtttgcaaaaattttctcccattctgtaggctgtctcttcactatgttgatttaatttcccgttttttaccagcagtttatgagtatttaagagaaacctaattagcatattatttttcttaagatgtttcccaaactgttatgtgaaaatgacatttcattgttttaacttgcaatgtttgcatagatattaatgtttagtttttatatttttttcatatatttgttaacatttttttctctgagtggtacacatagtgctcattttaagttgtgtctcagaggttctttgtattgcatttgtacacctttttgtttaaaactaaaatataggtacacaagagaacctacatgaaatgaaggtagaacttaataaattatcatcgggcaaagactcttgcataactatgacccaggtgaagaaacagaaggtctttagttcttgccactcagaagtcactccatgtcctccatcccagtcacaatccccttctatcaaaaagtgaccaatatcctgtgcatgcccaggatctaactctgccatgtctaacagaaattgcatgctcccaggctaaaagataaatgattaaagttgtaccatgctgggagatgttggagcatcagcccagctagtatggagagaccacaccaagtgccttgggcatttagttgagataacaaaaaggccactgtgtggaagtcagaattatgccctggcataagagtcatgtgttaagatgaaataaaaaaagcaccctctcgccctaacaaagaaaaaataccaagcttgacaagacccggaataagtgaaaatttaactaaccaccagaaataaggtaaatacccttaaaagagaatgcataattcatactcatagcaatgtatcatgtacagtgaacattgtacaatcaggaattactagatacaccaaaaaggataaacctagtgcataagaaaaactgccagacagtaaagacataccccttaaatttatacaaataaagaaacaaaaaagaaaggcacaaatatgacccaaatattgaaattactggtaaaataaattaaagcacctattgcaaatatattctgatacctaaaggaaactatggtcatgctgaaagcagataaatattcttagcaaataaaagcaattcataaaaaagaactgaatgaaaattttagaaccaagagtacaatatctgaaattaaaatttcacaggatgggtttaaaagaagatttaacatagcatataaaaggaacagaaaatttgaagacagatcaacaaaaagcatccaatctaaagaacagatagaaaaaaaaaaaaaggaacagaccatccgtgactatttaatcaatatcaagctctctaacagaattaaattttcagaagaaaagatgcggaaaggtccatgtggagagcaaccaacagccagtacaaacttgccatctatctatgtgagtgagccatcttgaaaatcaatcctccagtcctagtcaagccacatcaacagatgtggtgtgagtagagactggcagctcctgcttgagccctgccaaaatttcagattcttgagcaaaacaaatgatagttgttgtttaaagccaaagaaagaggaggaagaggagggaatggaacaaaaaataataattttaaagaaataatggccaaaaaaatttcaaaattttataaataacataaatagaagccaacatatcagctaaccttaagcagaataagtacaaagaaaacaatgtctagctatcatagtcaaactgttgaaaatcagacattaagagaacactttgacagaggatagtcacatgtatatatgatttaaatgatcactgacttctaactagaaacaacagggaccagaagacaatgagccaacactttaaggtaaggaaagaaaaaaaagagtcaacccagaattctacgtccaaggaaaatagccttcataaaataaaaatgaaatgaagatgtaaattaaaactcagaatttctagcagaactacactactcaacatgtaaaataaaattatttatcctgaagagaaatctcccaagagagaaacttaaatttagaggaaaaaacaaatactaatggaaatagtaagtctgtgggtaaatataaggattatgtagttatttttacttctgttaatatctttaaatacatatgactgcttaaaacagtaattatgatactgtacttcaggatgtacaacatgtatagatgggatgtagattaatataatagcccaacagataggcaaacagaactttattgttgcaaagtttttacatttaacacaaaatagtaaacgttaattctaaatagatgtgacagggtatgtatattgcaatctctagagcaacctttaaaaaatgcaaagaaaccataggttaaaaagtcaacaaaataaaaggaaatcaaaaaatatttgactaagccaaaagacatcaggaaagaaggaatagaggttaaaacatatgagataaatacaaaacgaataggaaattgatagacttatatttaaataagcatatcaataattgtattaaattttcacagactacacataccaattgaaaggcagagattgccaaactgggtaaaagagcaaaatccaactatatgcagtctataagagatgctctttaaatataaagaaaccaataaagtaaaaggatgaaaaatgatagatcatgcatataagttatacaagcataaaaaactaaaatgaggatataaatagctgaagagatagacttcaagacaagaattattatcagaagtaaggaagaacctttcataatttaaaagaacctactcatcaagacaacaaaacagtcttaaacatgtaaacaactaataacaattagaaaatatgggaaacaaaaatgactgaactaaatcgggaaaatgtaaatatccacagtcgtagttgtagtttttaatattttctgacagtaactcatagaataactagacaaaaaataagaagggatatagaagatctgaacaccaccatcaaccacactgacttgttttagcccattttgtggtgatgtaacagaacaccagaattcataaagaaaagaaatttatttctcacaggtttggaggctgaaaagtgcaatatcaagctgctggcctcaggtgagggcctttctacttcatcatcccatggaagaaaatgaaaggatcacagagggagagaaagcaagagagcaagagagggccaaactcacccttacaataacaaacccattccctcaaaagtgatattaatcattataatcatgccctcatggcctaatcacctcttaaagatcccacctctcaacactattgcattggggactgagttcccaacacatgaactttgggggacaggttcaatccacagcaggaccctgccctccaaaaatacagaggtattttcaagtgcacatagaaaatttatggagatagacaacatgcttcgccataaaacagcagcttctagaagctgggaaaggcaagaaaaaggattcttccctaggactcctagtatgaacacatccctgccaaacttttagcccaatgagacccattatcgacttccaaccaccagaactataaataataaatctgagttgttttaatctactaaggtttggtactttgttttagcaatgataaaaaacacatgcttaacctctacaactaatatcaaatataaaaatagagttctcctggctgtagcagggagtagggaggcaacgttttctctccaatctctgcagtggttctctaagaaacatggcaaaagcctggaaaggttttgtgtgtatggtacatctaggctcatagtaccataatcagccttccagaaagattccccaagcattgcaacaagtaagcagaaacatatgaaataaaaatagccaacctaacaaaaaaaatgagtatccttttgtacatctgagttttaaaattgaaattaagtagatatttcctgatttcataccatcaatattttcttatcatagagtggatacacacagaaaaattactgtagataattccttacaggataaatcagtttttgaaataaaatcacaatttaaatgaataaaaaaaattccttcacaaaatatgcctaaattgactctgggatatagaccactaattttgcttgaagcaagatgcaatcatgcttccaatgataaatcattttccaattctagtaacatcttgattgttctctctagatattcacaaattctgcacatcacactagctgagaaaagcagaaatgaatatattactttaatgagtaatatatttaatatttaatgagtgccttagtccatttaggctgctataacaacatacctttgactggtaatttataatcagaatttattgcttacagttctggagactgggaagtccaagatcaaggcaccagcagatgtggtgtcctgtatggacctgttccttatagatatcaccttctttctgcatcctcacatggcagaagagggaaagtgctaataagctccctaaggccttttttataaggcactaatcccattacctaaatggcttcaatgtcataactgatcatcttttctcactttctgtctctaaaataatagacccttattattttcacaggtgtcaacaatatcattaaacatgcactctttaaaattttaaacataagattaaaatgtaatttaatgtctaatacttaaataaaacaaattatgtttttatttttaaacacctttatttgaggtacaacatacataccaaaatatttaacaattacaagtgtacaattcaatgaattttagtaatgccacagagctatgcaactatcctcgcaattttagaatattttcgtttctccaaaaggatcctcatgtctattttacttgccttggcatcgttttagaaaatcccttgaatgtaaatgtaaggatttatttctgaattcctgattatagttcattgatatgtctacctttagacaaatgccacattttaattacaatagctctggttttaattacaatagctttgtagtaagctttgaaatcagtgtgaggtctccaactttgttcttcatttcaagactgttttggctattttgtgtccctttgcaattccatgtgaattttaggatcagcttgtcaatttttgcaaaaaaaaaaaaaaaaaaaaagcagctgagatttttgactcggattgtattgaacttgtagatcaatacatcaatttgggagtatcatcatcttaatattaagtcttccaattcatgaactacaaataattgttaatttgtttaaatcttactccaaattccaattctaaaaatttctgttcccctcccccactgcccccagttgtgtccttaagagtatttcttgatagacacaagaaactagtactggttgttgctgctaggaaaacacctaggtggctttgagacaggaagggaagaggactaacgtagtttgaatttgcgtccccacccaaacctcatgttgaattataatcctcagtggaggaggggcctggtgggaggtgactgaattatggaggtggacttcccccttgctgttctcataatattgagttctcatgaaatctcacttaaaagtttgaaagtgtgtggcacatccctttcctcctcctgctctagccatgtaacatgttcctccttcctctttgccttctgccataattataagtttcctgatgcctccccatccaggcttcctataaagcctacagaaccatgagccaattaaatcacttttctttataaattactcagtttcaggtttttcttcactgcagtgtgacaatggattaacaaagaaaattggtaccaggagtaaggtgtcactataaagatacctgaaaacgtggaaacagctttggaactgggtaataggcggaggttggaacagtttggagggctccgaaaaagatagaaagatgaaggaagtttctagagactttttgaatggttgtgactgaaatgctgatagtgatatggatagtgaagtccaggctgatgtggtctccgagatgaggaacttgttgggagctagagtaaaagtcactcttgttatgctttagcaaagagactggcagcagtgtgcctctgctccagggacctgtcaaactttgaatttgagagtgatgatttagggtatctgacagaagaaatttctaagcagcaaagtgttcaagatttggcctggccgtttctaacagcatatggtcatatgcatgtgaagagagatgatctgaatctggaacttatatttaaaagggaagcagagcataaaagtttagaaaattgcagcctcttctttaggtggaagagaaaaacccattttctggagaggaattcaaaccagtggcagaaatttgcataagtaaagaggagtgcaatgttaatagccaagacaatggggaaaatgcctcaaaggcatttcagagaacttcacagcagcccctcccattcacaggcctggaggcataggaggaaagaatggtttcatgggccaggcccaggtccctgctcccctgtgcaacctcgggacactgatctctgcgtcctagacatgccagctccagctgtggctaaaagggccccagatatgtctcaggctgctgcttcagagggtgtaagccataaacattggtggcttcaatgtggtattaagcttgtgtgtgcccagagggcaagagttgaggcttgggagcctctgcctaaatttcagaagatatatggaaatgcctggatgtccaggcagaagtctgctgcaggggcagagtgctcatggagaacctctactaaggcagcatggaggggaaatgtggcattggaacccccacacagagtccccagtggagcactgcctagtggagctgtgagcagaaggtcactgttctccagaccccagaatggtagatcccctgacagcttgcattgtgcacctggaaaagccacaggcactcagtaccagttgtgaaagcagctgtaggggctgtgctctgcagagccacaggggtgtagctgtccaaggttttgggagaccacctcttgcatcagtgtggtctggatgtgagacatgaagtcaaaggaaattattttggacctttaagatttaatgactgccttgccaggttttggacttgcatggggcctgtagccctttcattttggctgatttctcccttttgggacaggagtatttagccaatgcctgtactctcattgtatcttggaagtaactaacttgttttcgattttataggttcatatggagaagagacttgccttgtctcagatgagactttggactgtgaacttttgagttaatgctggaatgagttaagacttaggggatcactgggaaaggttgattgtattttgctgtgtgagaaggacatgagatttgataggggccaggggcagaatgatatggtttgaatctgtgtaactacccaaatctcatgtcaaattgtaatcctcagtgttggaggagggggctggtgggaggttactggatcatgggggtggacttcccccttgctgttcttgtcatagtgagttctcatgagatctggttgtttaaaagtgtgaaatgtgtggcacctcccccgtgctcttcctcctgtttcagccatgtaagagatgcctccttcctcttctgccataattgtaagtttcctgaggcctccccagacatgtttccagtacagcctgtgggaccatgagccaattaaacctcttttctttataaaatgcccagtttcaggtatttcttgaatggactaatataaggacttatattttactttctacccttttgcactttttggattttacacactgcacatgtataagttatttaaaaattaaatttactaaactgtgctcccagttttttgaggtgcaataagatgcacagacatgaatgtgttagatgggtcatatttgtgtaattaattcctgttctgctcttagacttctctgaacattgcctcacgttgttagtgaaagttcccagttcttgtcaacttgggagaaagatttcaggcaagagaagatttaaagatgagagaaagctttaatgaaaggaaatagggagaaagagcttgttgtaggacaaagtaagtattctcccagacaagagtgggctgatcctgcaggaaaacatcttcgagggtcctgttctgtgagttttaacatgtagagctccctttcaagttcccacttctgtcttaagtaagtctccacctttttcctttgtctacttttcctgcttctgctttaagtctccactttttttcctgcctatgctggtgggattcttcaatatgtttgttaatacccatgcacaagttggtgatcaatatgaatcttgcttaatggcatccctgctcattactgccactccaggaaggttgtatggcagtcaaatatctatctattgcacctgaatatctcttaggaatgtcctcccttgctctcctgtgtacttgtggcaccagtgtacctcttaggaatgtccccttttgccctctttctgtccttatcagcatgtacctactgacattgtgacattttcactgcagagtgaatgattactggggcatcttaaaaggaattccagggcatttctttctgcctaggtacttcctctccttcttgcccaccccctccagcattagagattctattgctatgaaaattttgggtggtcccttgggtctgagactctccagacctttcctttctcaagtggtccccctcctgctcatgtctggctatctgcatactctaacaacatcaggctatctcatatctatttcttaccacctctccagtttctcttcttaatcctcatgcacaattttatctgtttttggctctcattcttctcgatattttagttagctattgatcagtttgctttcttctggcttaaaccaggtacttataagcaagtatagactgttctctcttcccttttccattcctggctaccttctacttcctgcctcaccctaatataatctatagtaccacaattttatctcacttttgtagggtaagataaatttttttatctacttttgtaggtattttacttttatcttacttttgtactatttcttaccctagaaaggctgtatttcagacactttcttcctctctttgaaccattaacttagatttcctaatttcttacctgtatgtcttgaatcttgtacttatttttgctaatatatatttttaagtaggtagtcataaaatatactctctgtaacatggattttatttcaaaacttgtaagtattaaaatataaaataaaataacccatgtattaaatcaatatttattaacaaaatgattgtgagttaagatacagtacctatgagaataaaacatgcaaaaatgcttattttcaattataaagataatttttaaaaacttcaatagatttagaggtacaagtggcttttagtttcatggatggatttgatagtggtgaagtctaggcttttagtgtacccatcgcctgaatagtgtacattgtatccaaatatgtaattcaactataaagataatttaaacagagtatttcaagcaacataccaaagatatttaaacaaatatttaaagaagtactgtgactttattctttttaataaaattattatttttattacaatgtaatttatatttgctgtgaacaaatcctatcattacaaagcatataaaagttagtccacttgttatctcaatctctacaggtcactttacatttttttcatacagatgtattaaaatatattagttagaagatgcttcctgctgtaattgaatatatgactaatggtgacttaatgatttaaaaccttttcttatgtcacataatcaagaagcctgaagatcagtgatcccagggttggtgggatggctgagggctgtaggacccagcccccttccccctgctacttcttacctgttgcctgttttcccaggaagtttcttgtcttgtggttataagatggctgccacagccccaagtgccacatctttgtacaagggcattgcaggtagtaggaaatgactaaatgaagaaaagacacttcctttcatcaaggagaaaaataattccacaatcttctctaccccttggtcagacctgactcctttggcaaatttgtgccaagaaggctgagaaagtgaatatgtggcatattggaatgatgatggaaatgacatgaatatagttggccaattacgatctttttcagagttctaggaaaattgtttctgcaaaataattgtgattcttttttattatgaaacaagaggagaagggatattgagtaggctgctagtagcagctgctgcacacattgtatcagtgtgtgtgtgtataaagacttaggtttgcctttaagtaattcagacccacaatagcactcatttaaacagaaagattggcctctcccctgtaaaagttcagagcagataggacaaagaatcagtttccttctagatttcccctttgccacctagagaatgggctttttctccttggttcgaaatggtgatcagcacatgtaaattccaaatggtgggacgagaaagggacaaggtcaaaaagggtcaaaagggcctgcactggctgtcgtttaagtaaggttccttgaagctgctctgaaacattctgcttctgttccattgtctgatacttagtcatgtggccatgcccagctgtgagggagcttgagaaatgctccttttatgaccaatggctacgtgtttaggtaaaaattagtgcctgtgagaataggagccctaaagaatgaaagtaaaatggattccagaggattgttagtagtctctgccatttacgggcataaaggatattcaatgttgtcattattgtaaaaagagcatgattttgaaagtatttatttgtatcttctttttatttaaaggaatatttttaggttaaggcatgtgcaagttgtggggagccacacctttcagttgtttaatttatccctacattttttccaatctagtattttgatcaggaccaaagcaaacattactgaatgacactgaattttcctattgtagacattttgaaaaacatttttgatagttgtctttttgggcatgacttgaaatcataaacatttccaaaaagatgtgaagaaaagaactgaaagatttctccagggtcttagtcaacactattcaggtcttttattctatgaaagctgtgtatgaaatcctgtcaccacagggtaaaccattaaatagacggttctttttcttttttgagcttttctttttgtattttttctgaatgtttaccagatactagatattaggattttattgaacagatttgcgtgtgaaaagaaaagccatagtaatctctttcatgtgtactttttgaaattgcttctgcacagattaaatcttatatccaagcttagaagtaaaaagcaagctagtcatataattgttcttcatctggcctggttatagcctgctgcaggaagctcattcaaatatgggcgcttcaatatttctagcacaaaataaaaatctatcttttttgttcacctaaataataccatgtcagtgtatctttattagctctgactttgtgaaatgaagtttcaaagtctactaagtattctctaattcaaataattgctctaacagaaggaaacaagataactgtttccctactcaaatatcatatagtctgttttcaatctgtctttcattgctgcattggtggaatgcctgcatttaagagagaacttctgtttgccagtcattcctcacagtggtgctggtgaccagctgtctgagaatctactattaagggttgcattctgcatgccacatgatgtcttcttcctaataccgtttagctctacaatattctttatgaagtcccttaatcactccattattccatgttgctaagcggtcaagcaactgctagctactgaaaggagaatttgcttcacatattttgtaccacatttaagtaggcttagatttttgtaatgtcacagatggtgtagcacaaataagaaggttacagggactgtggtaatatttggactctgcttacaactgggatttttggagctcttctctgtggcattgtttgattttgtttattttttattgaagttctgctactgtattagaatattagtcatttatgttttattatatacagaacattgttctgggtgctttgacagatataatacagcaataagaggatttttgcccatttatccatctaaactcttaaagtaattgtatggggatatagtagacatttcccctttttacctcaccctaaccccaatatttgaagcttcttgtaacttgggagactgcatctacctctcactagagaacctcccttcttagccttccttgtgtctgtgtaggcatgacccttgacttagctctgaaaagcaggtatatatcctcagataaaggaggaaccactcaaaatgcgttctggtgaagcaaggtggtggccacttctgaattcactttccagaagcaacaggcaacagtagtaaggggtgtagcaggagcacccagtggctggcattgcagcattggaggttttaaggtgtctgtatccacaggtggtcatcatgttgttttcataagaccagttttgtgatacaaatttgggcatttccctggtggggaagtctctatgactaattgctgggctcatctggagattctgtgagttactaaaaatatttaatagagtgagaatttttactgcttgtaactaagcatactgattgatacaagaggctagaagctattataccattaacaagtaacaaggacaggtaaaataaaaacttgggggtagacatattaacgtgatctgatggagatagataagggctcaaaagataggaaagattcacacaagatgtagatgtggagctctgcagccttaattaattcaacaaatactgtgagctgctaatggataacagaaatggtattacatgcttaagataaaacaatgagcaagaatgacacagtcctactttcatgaagcttacagtacaacggggaagaaatgaatcaagttattataacagttctgtcaatgtagaagaaatgaattaagttattataacagttccgtcaatcactctgttgggagaagtaagaggatataatgtaaacctttatcaagggcacttgtatctagaatactcaggtgagacttccttcccagagagactttaagaaacattgactatgcatggatcatgcctgtaatcccagcaaattgagaggctgaggcaggaggatcacttggacccagcagtttaagaccagcttgggtaacatagtgagatcccatctgttaaacaaaaaaaaaaaaaaaagaaacattaaattaaattaaagggaattgaaggaagacagtctgggcaaagaatgtcccgggaaaggcatcagcgtttgaaaaacactttgcagtgagaaagaaaatggcacatttgaaaactgaaacattttctatgtgcttaaaatatagaatgtggaaatggggagtggctaggatgatctggagaagagaaccaaatatattttcttctgtatttagttggtgattagtgagagtttattgagttagtgtttatgaaagataatgccaatactgcaaataatacgcaacgttatggtgatagtattattttttataaataaagattgctctgctggtccttaaatacccattattaagtcttaatatcctgtgtaatcttgaaatacaacttggtatgggtttgtgataatctgaagaagacgaatcattccaaacaactctaattgagtcaaactagtacagtgctctgtaattacaggatttttaattcatgcttttagaactgatgggagactgtaacaaaattcgggaaatgttggttttcttactttgtaatggttgagtatctctaccttgttgtgtgatagtatactgaatgggaataggaatagtagcagtgttcaaatggataaagagagatagacatatttaaggtatatttaggatatttggtatatattaggatatccattgactaaaaggataagtgaaatgaagaaagcgatgcagtcaagatgtcgatccttatatgaaagtcacagacttgtgcttcctaagtggtctttctgtctacctgtgattatttagttgatattaaatacatcacataaaatttacatttattcatcttgtcatctaattttgaaagtgcaaatacctttaaaaaacataatagtaatgtacctaaatctactcctcttctcctttgactagcaagactttaggtggaagatccaggatgtatctatttcactctagtggctgaggcaaaatttgacatttgctttagataatgatgaatttgaatgacacttaggcatatattcaaagagttgtatgtgatttattacatataattaattatataattataactataataattatgtaataattatgttaagtaaaattatgcatataattataacaaataataattttccttgatatagcagtttctatttattttcaaacacattttcattattctattttatattcaccaaaactctgtgaaaggcaaaattatccctattttacatatcagcacacactagcttataaaaatttaatagctgtaagtttatccagactgcaggtagcagaacatgaacagaagcttggattttcagctccttgttcagagacagtgaaaagagttaaacatttttttttaaacactgggtgattgttttccgaaggtccaggatgcgtactgcattaaatgaagacttgaagatttattaaaaataggagacatatgaacttctaactagataaccaatcacttaattataatttggagtgatgtggttatggtgcttttccttaataaaaatacaagctatatttattcaaccaaagtgaaatagagggttgatcaattgtttttcaaatgtcactcagtaaagagccattaaaatcatctagtcattatttcatgtcttattcattagtgtttttttttttgtctttgttttatattttggactgcattactcctttaagctggaattagtccctgtgcttgaaagtaaagacattattttctcctatttgcacattttccccaaaatcttgtgcaacctccagttaattgcactcaaaattattgatgcttaggagctcaaaaatgccattgcataaaaaaaaaaagcctttcaaaacccagcttggctttagaagctaacttgctgaaaaatgcttatagcaatgaaatatcattattcagctctgtgaggtgctagctggaaagttacaacgtcattgcttaaagggctatatttgtttatagatggacagttacaagtgactctgggggctgaagttttgtaaaattatacacttatataggtctcctgttggcccagttatgtaaatctacaaataggttttcttggcacgagggccacataactgacgataaaactctgactgttaaacgggatatataattaccaatgaccatggttggatttggtcaggttttaatcagtttgcagaatacattagtggtgcttgaaaatcttatgaaatataattccttacacaaaagccaattaatttatattttctaaagaacaaaattaaatgatagtttatcaaacatagaatttaaatattgtatattaaaaacacaaccacacacacagacgtgaacatacagtgtatgtttattataaagttttcaaatgatctctagggagccaaagccccttctgcatgttatcaagctaagaaccctaacttgatagtattctattagtaggtttgaaaatggcagtggagggctaaaggaggtggaaaaaaaattgaagtgccagacttgggcgttagtagaggtaatttgctgtattctgtcttaattgggttagaatgttgaaggctttgagagagaatttgtttagaagacaatctgattttcctgaataggaaagtttagaaacagtgtttgttaccactatgttaatagaagtgtcatattaagtactataggatttttgcatcactgagattcaaggaaaaattccataactagtgaatcagaagtctcggcttttactgaaaaatgaggaaaaagattgccatctaattggttgtctggacttatgtggacgttatctagaaaggccacgataggaaacctgaactacatggtcagacctcagaactgttttgatcccaaactaatttcctcaagtgaatagtaagaaattgctttcttataacaatttcaaaaggaatgaaatgggggaaagaagtgggttatcaaataaatggcaaatgctcttattaaaaaaaaagacccacaaacgacattagtctctccaaagagggtaagagaggtttggggaaggggataagaaagaggaaaaacattattgatcctcatttttgtctttcaatatttatttttagattactcctgaaaaaggtgaatatccatatccattgtttttttttttttttttttttttttttttttttttttttttttttttttttgtgagacggagtctcgctctgtctcccaggatggagtgcagtggcgcgatctcggctcactccatatccatttttaaatggaataaattgctgtatggtggaggatgagctattttacaaaacatcgtagaataaccaccaaataaatacattcttcagtttggagtcttttgttttttcatgaggcatttttttttttttcctaataagtttcgttgcttcactctagaggctctgataagatgcgtcatccaacccaggcttaaaaaaaatgcctcatgagataactcaaagaagttataatgccagcattcatttacaattggtagccttcgttaccatttagaacatttgttgagaagatgaagctgttatcctttatttgagagcaaattgagtgagtgtaaagtgccctctgaatattctgtaggacatcctgtttcctccctatttcctcacttcatgtcctgcaatggtgacagctgtacttacatttagtacccaggatttcgacttttgtatccagcctcttcaatgatctcttaattgctgctgtgcttgagtactctgccaaaatacaggagggcggcgttagtctgggagaggatagttcctcatggattctgcttcagcttgcccaggctcattaacactcagggttgttgcttttgcagctgctttcccagtgaggttccatttaaagcagttttgaaaatattgagagacaccagagtaacaatgaggttttcttccttttttttttttttttttcaattttactttaagttctgggatacaagtgcagaacttgtaggtttgttacataggtatacatgtaccatggtggtttgctgcacctatcaacccaccatctaggttttaagccccacgtgcattagttatttgtcctaatgctcataaaaatgttgttttctgaaaacagatgctactagtctgtgtgggatattatctcagcatcttattaaaagcaaaaagttgtataagccccattgcttttaataggcagcacttttctactaaatctgggaatattgtaagccaaaactaaaaattaacagctcagaatattctaaatatagaagataaatatttaagatactagatatggaaggtattactgatcttaactctgaatgcatttcttatttctgttctctacccaggtgctgttgtctctcacctggtttctctagttcttgtgtaagtattttagtgtgtgaatagttgtttaaatgtttctgcaagaggatgtgcactggaaggttctatttcatgatcttgacagtgtcactggagcaccctcctggatgcatttctgtatcttcaaaaggaatgccggttaaaatgttaataaagtctctgagcaaagttgcctatacataaaatcccagctacttgagagactgatgctggaggatccttggagcacaggagtttgaggtttcagtgagctatgatcatgccactgcactccaacctgggtgacaaagcaagacttcatctctaaaaataaatataaaatgaaataaaatgtcaatgaaataatgattaaataatctctctaatatgtgagtttgaatgatgagaaggaaccaagatgatatccacatgccaaggagctttagttgctgaatgtttaacaaacgtgggtgtctggaaattattattcttggtggtattagaaacttggtagatgtgtgcagcaagttaatatgtcaaaatgccaggttgcagcagagaaagaggtttaattgtggggccgctgaacaaggagacaagaagaaacctcaaattcatttctcaatggagcttgcgactaaggtttttaagagtttcagagtggatctaaatgtggagatcactgattggctgaagagtgcagggtgaagtcatggggcagggagatgaaaaaaccgtagtctcatgctgattcggttccgttgtggtggatctttgaactggttggtgtcagctgtgcccttgaaagtcaggatctgcttaagcaattcttaaacaaagatcttgggattctaatatggagatcctatctatcttaaacaaaagccttatgactaatgtcagaaattttatctataggaacaatggggatgcaaatggtctgtatctagtgctatggggactttcggtttcaaggaagtgagtcaaagtgcagcctgattaatgcttaaatataactcaatttatgtccagaattcttgttaaccctgtgaggatggcttcttcaagacctgctaccaaaatgcttattctggtctcaggctgcaaggaagcagaggatttagggaatttggcctgcatatgctcaaggaggtggctccttttacagatagacttaaaaactcttgccctgaagaaaacagcctctgttttcatgcagacgagatacccaagtgagggcctcagtgaacatctgacaaatgcttctgttagcacaattcatctggctgaccctggctgatacttccaaatttgacttaaacatatttcattgaatctaagacaccagtggttctaagacagagcattgtttactatgtaagagaaaaaatgatgacataaaggtaagattctagtgtctattattgagggttctacagagaaacagaaccaataggagatagatagatagacagatagaaggatgagaggggatttattaggataattggctcacatgattagggagacccagaattcccatgacatgccatttgcaagctggagaccctgggatgctggttgcatggctcattccaagtccaaaggccttagaactaggggagctgatggtgtcattgttaatcagagactgaagacatgagcactccagggagcagctggtataagttcttgattccaaaggctggagagcctggagtgctgatgtccaagagaaagagaagagcattccagctgcaggggaggaggggagagagagagagacagagagaaagaattgtcttttctcttccctttctattctatttgggcctccagtcgattggatgatgcttacccacatccagtcgtctgggggcccagatagaatagaagggcagatatttcccactcagtccatatactcacaccaatctcctctgcaacaccctccaagacatacccagaaataagttgacacctgaaattaatcatcacagactctaagatgcatctttgaattgtcttaagggtctgtgatgtgcacattaagatgcacagattctaagatgcagagaaaacatgcatttaaaatagaataaataatcatctcttcacctgaatccaagtctttcctagttggggacgcctaaacttcatcgaagccttaaataagccataagcttattcattgtcttgtgctttacacagggggttttatctttctctttccactttgccccagccctctgtcatatactgtagaaattgcataaaatcaggagctgttacattatgggggagccccagctttctttctctggccttgcatggtagtatgtggatatatggatacagatcatggcaatctttttttctcccttggatatttttgtctgataataaaaattgttttgttcgtaagatgtaattaatcttggcaattcttcctttagtgccgctgtaagagttctctatgagagagagtacctagttctctaggtttcctgattcagtctatgctgaggtgcagtcctccctgatgacatcttctgcttctgaacagttaatagaaaagtcccttcttccctctaaccaatatcattcataacaattatgctttgagccccttcaatgtttcaggcactattataggctctattgaacataacatatagagcattactgataggaattacaagagccaactgtatttgagcaaagacatgaagaaagtgaagcagtgggctatgtggctatctaatgggagaaagtccctgggagggagtagcaaaggaacagttccattgtgcatagtagaacatgcatagtgtgtttaagaaacaaggcagcaaggaatacgccagcttggctgaagtagaacaggaggacagtagtaggagatatgagcagagagatgttgaggagagggcagacaaatgtaaaagactttgatttttactctgaatgagatggaaaggcactgaaggaatttatacaaaagagtaacatattctgactttatttgaaatgcatatgttaagtctatgtgaagggagaactttaacatggaagagtggaaacaatgagaccagacagaaggctagtacaataataaaagagagtgatggtagcacctgcaagagttccagttgaggattaaactctgattttttttttatcttgcccaaattcttatctaaaaagtggtctgggggtcatgccctacaaatcataaattctcatcagatgtgttttatttaatcctatatatcatgacttactttccaaactgactctggcataacattacgagacaaagaagaaaatcaaaatattttacatcaaaacatgtttctttgccgtattttgaaatggccctgcagagctattctttgtgggggaaaatttgcatctgtaaagactctctattaacatagctagatctttttcttccagaccctcctaatcctaaacagattaactaagatctgaataggaaacatttgtcacctatagcctctaagggcagccactctaagacttcaaaagaactttgatctctacaatctttatcttaacctgaacattccattgtttctatctatcccaggtctttagacaaactcaaccaattgccaaccacaaaatgtttaaattcacctatagcctagaagcccccactttgagttgttctgcctttctggaccaaaccaatgtagttcttaaatgtatttgattgatgtctcatgcctctcaaaatgtataaaaccaagctgcgtcccaaccaccttgggcacatgttctcaggacttcctgagggctgtgtcaagggccatggtcactcatatttgtcttagaataaatctcttcaaatatttcagagtttgactcttttcgtcgacacagtggtggagatggtaggaagtagtcagtcagtcctggatatgttttgtatggaaatctgccaggttagattgactaaagggtagggaatggagtccaggatgactcagggtgttcggcctgagtagcctgaacattgaagctgccattgactgagatggacaatcatgtgggaaaaacggtttgaggggaagaattaggagatcagttttgggcattgtgatggttaatactgagtgtccatttgactggattgaaggatgcaaggtattgtgcctgggtgtgtctgtgagggtgttgccaaaggtgattaacatttgagtcagtgggctgagtgccgtggctcatgcctgttatcccagcactttgggaggctgaggcgggaggatcacttgaggtcaggagttcgagaccagcctgactaacatggtaaaaccccgtctctactaaaaatacaaaaattagctggccatggcagcaggcgcctgtaatcccagctactcaggaggctgaagcaggagaatcacttgaacctgggaggcagaggttacagtgagccgagatcaagccattgtactccagcctgggcgacaagagcaaaactccatctcaaaaaacaaaacaaaacaacaacaacaaaaaatttgagtcagtggactgggagaggcagacccaccttcaatgtgggtgagcacaatctaatcagctgccagcgtggctagaataaagcaggcagaaaaaggaagaagtggacttgcttagtcttctggccttcatctttctcccgtgctagatgcttcctgctctcaaacatcagactccaagttctttggcttttggactcttgcaccagtagtttgcctggggctctcgagccttcagtcgccagccacagactgaaagctgcactgttggcctccctacttttgaggttttggaacttggactggctttcttgcttctcaacttgcagatggcctattgtgggacttcaccttgtgatcgtgtgagtcaactctccttaataacaccgcttcgtatatacatctgtcatattagttctgtccctctagaaaaccctgactaataaaggcatgttaaattggcctgtttaatattcaggtggagttttctgctgttcaatactatgtgaagatcctgcagaatcactaatatatagagtgaggtttattactcttgttagtcttccatttgtcatttctccacatttttggactgctcaagagggtgaacatgatattggataccttctaccatgtacacaagatttaagagagacttctcatgatggctttgtgaactgaagtgagtcataaatactgattagttgtctaacctaattattagtagtatatataatcttgtcaatatacttttctggtattgttattctttcctatttttatcaattattctaaattatgatgattgtcagttatttaatctacttagatgtgtgtaaatctcattcatatttagatatgacagtgcatattaataatatgtgttatattacttgaattgctttattttttagaaaagatcatgattaattgaatcatatgctgtgatgtgttcctctgttactcaggcctaaagagagtcttggaacattatgttgtctcctgagagcttgcttagtgggagaatctgacttgcagataatgccaaggggacaataaaagtctagcccaggccctttaagtagaagcaaatattctgcagcagatataaaaataataaaatattaccttcataatcaggtaaaaaatctacgtaaaaatgttaagagctcattaatatttatgattgccccatataagaataagaaagcagagaatataataatgatataatttctaaagtcctaattatgaacctgtaaactttttaaggtcacctgttaatccttaattaaattgtactttgacaactgagattacttacttcattagcattcttgaatttgcatataatttgcattataaaatttgttgttttctcaagattctctttactagttctatttatactgaatgatgtaattgctctttatttaattcccttcttaatagctctaacaattctcatttggtgaagataaaatgtaaaaatttagggagcaaaatgacaattaaacataagtacattaaatgtggactattagatgggactaatagttcaggcaggtttggtctttggcaataagggactttttgttggagtaggagtggcaatttcttttcttttcttttttgagacggagtctggctctgtcgcccatgctggagtgcagtggaacgatctctgctcactgtaagctccacctcctgggttcacgccattctcctgcctcaccctcccgagtagctgggactacaggggcctgccaccacgcccggctaatgtttttgtatttttagtagagacggggtttcactgtgttagccaggatggtctcggtctcctgacctcgtgatctgcccccctcggccttccaaagtgttgggattagaggcgtgagccactgcgcccggccggcaatttctttttttaaaggaccagatagtaaatacttcatactttcaggccatgtggtttctgtggcaattactcaactctccctttgtagaacaaaagaagccatagagaatctgtaaactaatgggctacatttcaataaaactttatttacaaaaacaggcattgaagtagatttggctatgggtagtagtctacaaacctctgttggagcccagatgcttcattttgacttccaagtgtttaggattcactgagaaaaccatcctactgtcaaatttccatccatctgcctattatctatgcattatttatgctttcttcaagtgacttttattttaatatgtataacatcttagggtaaaacatttcataatacattctttctgtggaagactttggtacctgtttttgtttttgttttttttttaattcacttcacatacctatggagcatttgcaatatgccaggcatgtaatacaaactatggataagtattttgtagaaggagcagctaatagtttgttttttgaaaaagaaaaaatagtataaaaacatacatttttaaagcagtggaggaaacagtatctaaagttataattttatcttaaaattaaatggattaaaatatgctcatgaagaacatataggacactttaattatttcgacttttattttaggttcagggagtacacgtgcagttggttacatgggtaaatcatatgtcactggggtttgatgtacaaatgatctcatcaccctagtagtgagcatagtacctgagagcaattcaacaagcaaaaaccaaataaccccatttaagaaatgggcaaaagacatgaacagatacttctcaaaagaagacatataggttgccaacaaacatgtaaaaaatgctgaacagcttgcagttctctaagtaagagggaatataggagttgagagaatcaaaggaagcctgtgctttgtagcagtgcctattcaccagaatgctatggtacactgtgatattccaaactctttgtaattttgacctctaatgaaaaattttttttttcagaaaaattatagaaatgaatttaagaggaaagactgaactcaacaagctatgggtgtaaagcgagccacaacttgctttacgagtgaaatgtgaagtgtaatataaatggagccaaggaaagattttgacttaaaataaatgctcaacattattaatcatcagataaatacaaattaaaaccacaatgaaacatcatcttacactagtcagaatggatatcattaaaaagacaaaaaagtaacatattgaggaggatgtggagaaaatggaactcctagaaactgttggtgggaatgtaacttagtacaacctccatggaaaacagtatggaaatttctcaaagaactaaaaatagaactaccattgacccagcaatccactaatgggtatctatccaaaggaaagaaatcattacatcaaaaagatatctgtttatcacagcactatttgcaataatgaagatatggaaccaacctaagtgtccatcaatggaagactggatacagaaaatgtagtatatatacacaatggaataccattcagcattaaaaaagtgaaatcatgtcttttgcaacaacatggatggcactggaggccattagataaaacaagctaaacactgaaagccaaatatggcatgttctcacctataagtgggagctaaataatgtgtacacatggacatagagtgtgaaatgatagacaatggagactcagaaggatgaggtgggggagggtggtggatcatgagagattacttggctaccagctcaccatagtgaggtagagcaccaagcagccttctagggtccccacttccaaaccttggctctgggatggaatttctggactgccttgggccagaggtaagcccactgccctgaatggagagacccaggcctggcaatatttacacaagttgactgatgagccctttggccttgagtgaacattggcagtagccacacagtactcgctatgggcctgaggcaatggtggccacagggagaaactactgcttgaggaaaggagagtgaagagtgggaaggtccttgtctcttgccagctcagttatgtgaaatagagcacctagtagatttctaatgtttctgcctagaggccctgactcccagatggtgtttctggacctgttgtaggccagggagagctcactgaagggaaggacacaagtcttgttggattggtggcctgctgactgaaaagcccttgggccttgagttaacacatgggcctgggtgagaccaagtgatgagctggcttcagttctgacacagcagagtcccagaggtggtggccacaggggtgcttgtgccacccctctcctgcctccaggcagcttagcagagagagaaagacaacatttgtttgggagacagtaagggaagagaacaagaaactctgcttggtaatccagaaaattatctcagatcttaattaagaccaccaaggtggttctgcaagagttacattattactgtgcttggggtgccccctaatgcagatacagcttcagggaccaaagacttagatcagaacactcaattcacttttaatacttggaaggccttctcaaggaggatgggcgcaaacaaacccagactgtgaagactacaatcagtatctagctcttcaatgcccagacatcaacaaacatccacaagcagcaagaccatctaggaaaacatggcctcaccaaattaaataaggcaccagagaccaatcccagagtgacagagatatgtgacctttcagacagagaatccaaaatagctcttttgagcaagctcaacaaaattcaagatagcacagtgaaggaattcagactcctgtcacagatttgcaagacaaaaaaaaaaaaaaaaaaaaaaaagatgaaaagaaataaaataaatcaaagaaagaaagaaacagaatcctataagataaatttaacaaagacattgaaataatttttaaaaatcaagcagatgttctggagctgaaaaattctattgacatactaaaaatgtatcacagtcttccaaaagcagagttgatcaaacataagaaataataagtgatcttgaagacacatttatttgaaaatacgcagtcagaagagacaaaataaacaagaataaagcacacctacaagatataggaaatagcctcaaaaaggcaaatctaagagtcattggccatatagaggaggtagaaagggagagagatcagggtagaaagtttattcaagtggataataagagaacttcccaaatctagagaaatatatcaatattcaagcataagaaggctacagtacccaaagcagatttaatctaagtaagactacatcaagacatttaataatcaaactccctaagatcaaagataaagaaaggatcttaagagcagcagagaaaaaaaacaaataacatacaaaggagctccaatacagctggcagcagacttttcagtggaagccttaaaggccaggagagagtggcataacatatttaaaatgctgaaggaaaaacaatccttttatcctaatttagtagaccaggcacgttggctcatgcctgtgatcccaacactttgggaggctgaggtgtgtggatcacctcaggtcaggagtttgagaccagcctggccaacatggtgaaaccccatctctactaaaaatacaaaaaactagctgggtgtggtgatggacacctgtaatctcagctactcaggaggctgaggcaggagaattgcttgaacccaggaggcagaggttgcagtgagccaagattgcaccactgcactccagcctggctgatgaagcgagacttcttcagcaccccaacagaaaaagtatatccagcaaaaatatccttcaaacatgaaggagaaatgaagccttacccagataaacaaaagctgagggacttcatcaacaccagatctgtcctacaagacatgctaaacagagttcttcaatctgaaaggaaaaaacatgttaatgagcaatatgatatctgaaggtacaaaacccactggtaatagtatacatatgcaaagaatattataacactataactgtagtgtgtaaattactcttaaatagaaagactaaaagatgtatcaataaaaaataataaccacaataacttttcaagacacagtacaataagatataaatagaaataagaaaaagttaaaaagcagggaggataaagttaaagtgtagatttttattagttttctctttgctcgtttgttagttgatttgtttgtttacacaatcagtgttaaactgttatcagtctaacataattgatcataagatgttaattgtaacctgcatggtactctcaagtcaaaaaaaatccaaacacctataagagacacacacaaagtaaaaagcaagaaattaaaacatactaccagagaaaatcaccttcacaaaaaggaagataagaaggaaggaagaaaggaaggaaaccacaaaacaaccaggacacaacaaaatagcagcagtaagcccttacttatccataataacattgaatgtaaatggactaaactctccaatcaaaagacagtggctgaatggataaaaataataagacttaatgatctgttgcctacaagaaatacacttcaccaataaagacatgcaagaccaaaaataaaaggatgaaaaaagatattccatacaaatggaaaccaaaaccaggaatgagtagctatacttatgtcagaaaaaaatatatttcaagacaaaaactataaaaagagacaagaaataatacacaggttaattcagcaagaggatataacaattgtaaaaacatatgtacccaatgctagatcatccagatatataaaggaaatattactaaagtgagagagagagagacggagaaagaggaggagagagagttagtttattgctagctagagacttcaacaacccaccttcagtattggacagaaaatcgacaaagaaacatctgatttaatctgaactatagaccaaatggacttaagagatatttacagttcatttcatccaaccaatgtgcagaatacacattcttctcctcaatacatcaatcattctcaagaatagaccatatgttaggccaaaatcaagtcttaaaacattcataaaattgaaatcatattaagtatcttctctgaccacaatgaaaaaaaactagaaatcaatgacaagaggaactttggaagtttgaaactttggggattttgaaaacatatgaaaattaaacaatatgcttctgaatgaccagtgggccaatgaagaaattacaaaagaaattaaaaaaaattcttgaaacaaatgaaagtggaaacacaatataccaaaacctatgggatacagcaaaagcaatactaagagcaatgtttatagcaataaacacctacatcaaagtagaaaatcttcaaataaacaacctaatgatgcatcttaaagaaatagaaaagcaagagcaaactgaatccaaaagtagtagaagaaaagaaataagaatcagagcagaaataaataaatttgacacaaaaaacaacacaaaatcaatgaaatgaagagttggttatttgaaatggtaaacaaaattgacaaacttttaggcagactaagaagaaaaccagaagactcaaaaaaaaaatcatagaggaaaaaaagacacaactgatattgcaaaaattaaagggatcgttagagactactatgagcaagtgtattccaataaacttgaaaacctagaaaaaatggataaattcctacacacatacaacttaccaagcttgaaccatgaagaaaatctcaaacctgaacagaccaataataagcaatgagattgaagtcatgttaaagagtctccaggaaaggaaaagcctgggacccaatggattcactgttgaattttaccagacagttaaaggagaactaatgcctatcatatccaaattattctggaaaatagaggtggaaggaatacttccaaactcattctacaaggccaatattaccccgataccaaaaccacatagagacacattaaaaaaaagaaaactgtatgccaatatccctgatgaaactgatacaaaaatcctcaacaaaatagtagcaaacttaattcaacaatacattacaaagatcattcatcatgaccaaagtgagatttaccccagagataccaggatagttcaatttacatgtatcaatcagcaagatagatcataccaacagaatgaaggacaaaaaccattgaccacttcaaatgatgctgaaaaatcatttgataaaattcaacatcccttaatggtcaaaaccctcaagaaagtaggcattgaaggaacatacctcaaaacaataagagctatatatgaaagatcaacagctagtagcatactgaatagggaaaaaactgaaagtatttcccgtaagttctggaatgtaataaggatacccacttttacctctattatttaacatagtactgaaagttccagctggagtaatcagacttgagagagaaataaagagtattcaaattggaaaagaaaaagtcaaattatctttgtttgcaaataatatgatcttatatttggagaaacctaaagacttcacaaaaaaaactattacaactaataaacaaatgcagtaaagttgcaggataaaaaaattaacatacaaaaaaatcttgggaggctgaagtgagcagatcaagaggtcaggagatcaagaccatcctggctaacatggtgaaaccctatttttactacacacacacacacacacacacacacacacacaaaattagccaggcaaggtggaatgtaactgtagtcccagctactcaggagggtgaggcaggagaatcacttgaacctgggaggcaaaggttgcagtgagccgagatcatgccactacattccagcctgggagaccaagcaagactccgtctcaaaaaaaaaaaaaaaaaaaaaaaaaaaaaaaaaaaaaaaaaaaatcggcagcatttttatatgccaacagcaaacaacctgaaaaagaaatcaagagatagctagcaagacggccaaataggaacagctctggtccgtagctcccactgagatcaacacagaaggtgggtgatttctgcattttcaactaaggtaccccattcatctcactgggactagttagacagtgggtgtagctcacggagggcgagccgaagcagggtggggtgttgcctcacctgggaagtccaaggggatggggaactccctcccctagccaagtgaagccatgagggactgtgccgtgaggaatgatgcactcaggcccagatactatgcttttcccatggtcttcgcaacccacagaccaggagattccctccaatgcctatgccaccagagccctgggtttcaagcctaaaactgggtggccgtttgggcagacaccaaactagctgcaggattattttttttcataccccggggtgcttggaatgcagtgagacagaaccgttcactcccctggaaagggggctgaagccagggggccaagtggtttagctcagaggagcccacccccatggaacccagcaagctaagatccactggcttgaaattcttgctgccatcacagcagtgtgaagtcaacctgggatgctagagtttggtgggaggaggggcatccaccactaatgaggcttgtgtaggtagtttttccctcacagtgtaaacaaagccaccaggaagttcgaactgggtggagcccaccacagctcagcaaagccgctgtagccagactgcctctctagtttcctccactctgggtagggcatctctgaaagaaaggcagcagccccagtcagggccttatagataaaacccatctccctgggacagagcacctaggggaaggggcagcttcagcagacataaacgtccctgcctgatggctctgaagaaagcagcagctctcccagtacaacgttcgagctctgataggggacagactgcctcctcaagtgggtccctgacccccgtgtctcctgactgggagacacctccaagcaggggccgacaaacacctcatacaggagagttctggctggcatctggcaggtgcccctctgggatgaaagttccagaggaaggaacaggcagcaatctttgctgttctgcagcctccattggtgatacccaggcaaacagggtcaggaacagacctccagcaaactccagcagacctgcagcagagaggcctgactattagaaggaaaactaacaaacaggaatagcatcaacatcaacaaaaagatgtccagatacagaaacccaatctgaaggtcaccaacatcaaacaccaaaggtagataaatccatgaagatggggagaaaccaggacaaaaaggctgaaaattccaaaaacaagaatgcctcttctcctccaaaggatttcaactcctcaccagtaaggcaacaaaactggaaggagaaagagtttcacaaattgacagaagtaggcttcagaaggtgggtaataacaaactcctccaatctaagggagtgtgttctaacccaatgaaaggaagctaagaaccttgaaaaaaagttagaggaattgctaactagaataaccagtttagagaagaacataaatgacctgatggagctgaaaaacaaagcgcgagaacttcatgaagcatatgcaagtatcaacagctgaattgatcaagcagaagaaaggatataagagattaaagatcaacttaatcaaataaagtgtgaagacaagattggagaaaaaagaatggaaaggaacaaacaaagcctccgagaaatatgggactatgtgaaaagagcaaatctatatttgattggtgtacttgaaagtgacagggagaatgcaatcatgttggaaaacactcttaacgatattacccaggagaacttccccaacctagcaagagaggccaacattcaaattcaggaaacacagagaacaccacaaaggtactcctcgagaagagcaaccccaagacacataaacatcagattcatcaaggttgaaatgaaggaaaaaatgttaagtgcagccagagagaaaggtctggttacccacaaagggaagccaatcagcggatctctctgcagaaaccctacaagccagaagagagtggaggccaatattcaacattcttaaagaaaagaactttcaacccagaatttcatatccagccaagctaagcttcataagtgaaggagaaataaaatcctttacagacaagcaaatgctgagagattttctcaacaccaggccagccttgtaagagctcctgaaggaagcactaaatatagaaaggtaaaactggtaccagcaactgcaaaaacataccaaactgtaaagatcattgatgctatgaagaaactgcgtcaactaacaggcaaaataaccagctagtatcataatgacaggatcaaattcacacataacaatattaaccttaaatgtaaatggactaaatgccccaaataaaagacacagactggcaaattggacaaagagtaaagaccatcgacatgctatattcaggtgtgcccatctcatgtgcaaagacacacataggctcaaaataaagggatggaggaatatttaccaagcaaatagaaagaaaaaaaaaagcaggggttgcaatcctagtctctgataaaacagactttaaaccaacaaagatcaaaagagacaaagaaggccattacataatggtaaagggatcaatgcaacaagaagagctaactctcctaactatatatgcacccaacacaggagcacccagattcataaagcaagttcttagagacctacaaagagacttagactcccacacaataataatgggagactttaacaccccactgtcaacattagacagatcaacaagacagaaagttaacaaggatatacagaaattgaattcagctctgcaccgcgcagacctaatagacatgtacagaactctccaccccaaatcaacagaatatacattcttctcagcaccacaccgcacttattccaaaattgaccacagagttggaagtaaagcactcctcagcaaatgtaaaagaacagaaatgataacaaactgtctctcagatcacagtgcaatcaaactagaactcaggattaagaaactcattcaaaactcctcagctacatggaaactgaacaacctgctcctgaatgactactgggtacataacaaaatgaaggcagaaataaagatgttctttgaaaccaatgagaacaaaggcacgacataccagaatctctgggacacatttaaagcagtgtgtagagggaaatttatagcactaaatgcccacaagagaagtcaggaaagatctaaaatctacaccctaacatcacaattaaaagaactagagaagcaagagcaaacacattcaaaagctaacagaaggcaagaaataactaagatcagagcagaactgaaggagatagagacacaaaaaaccattcaaaaaatcaatgaatccaggagctggttttttgaaaagatcaacaaaattgatagaccactagcaagactaataaagaagaaaagagaaaagaatcaaataggcgcaataaaaaatgataaaggggatatcaccaccgatcccacagaaatacaaactaccaccagagactactataaacacctctatgcaaataaactagacaatctagaagaaatggataaattcctggacacatacaccctcccaagactaaaccaggaagaagttgaatccctgaatagaccaataacaggctctgaaattgaggaaataattaatagcttaccaaccaaaaacagtccaggaccagatggattcacagccgaattctaccagaggtacaaggaggagctggtaccattccttctgaaactattccaatcaatagaaagagagggaatcctccctaactcattttatgaggccagcatcatccggacaccaaagcctggcagagacacaacaaaaagagaattttagaccaatatccctgataagcattgatgcaaaaatcctcaatgaaatactggtaaaccaaatgcagtagcacatcaaaaagcttaaccaccatgatcaagtgggcttcatccctgggaagcaaggctggttcaacatatgcaaatcaattcacgtaatccatcatataaacagaaccaatgacaaaaaccacgtgattatctcaatagatgcagaaaaggcctttgagaaaattcaacagcccttcatgctaaaaactctcgataaattaagtattgatgggaggtatctcaaaataataatagctatttatgagaaacccacagccaatattgtactgaatgggcaaaactggaagcattccctttgaaaacgggcacaagacagggatgccctctctcaccactcctattcaacttagtgttggaagttctggccagggcactcaggcaggagaaggaaataaacggtattcaattaggaaaagatgaagtcaaattgtctctgtttgcagatgacatgattgtatatttataaaaccccatcatctcagcccaaaatgtccttaagctgataagcaacttcagcaatgtccccggacacaaaatcaatgtgcaaaaaccacaagcattcttatacaccaataaaagactaacagagagccaaatcatgagtgaactcccattcacaattgcttcaaagagaataaaatacctaggaatacaacttacaagggatgtgaaggacctcttcaaggagaactacaaaccactgctcagtgaaataaaagaggatacaaacaaatggaagaatattccatgctcatggataggaagaatcaatattgtgaaaatgcccatactgcccaaggtaatttatacattcaatgccatccccatcaagctaccaatgactttcttcacagaattggagaaaactactttaaagttcatatggaaccaaaaaagagcccacattgccaagacaatcctaagccaaaagaacaaagctggaggcatcacactacctgacttcaaactatactacaaggctacagtaaccaaaacagcatggtactggtaccaaaacagagatatagaccaatggaacacaacagagccctcagaaataataccacacatctaaaaccatctgatctttgacaaacctgagaaaaacaagaaatggggaaaggattccctatctagtaaatggtgctgggaaaactggctagccatatgtagaaagctgaaactggatcccttccttacaccttatatgaaaattaattcaagatggattaaagacttaaatcttaggcctaaaaccatgaaaaccccagaagaaaacctaggcaataccattcagggcataggcatgggcaaggatttcatgtctaaaacaacaaaagcaatggcaacaaaagccaaaattgacaaatgggatctaattaaactaaagagcttctgcacagcaaaagaaactaccatcagagtgaacaggcagcttacagaatgggagaatatttttgcaatctactcatctgaccaagggctgatatccagaatctacaaagaacacaaacaagcttacaggaaaaaaacaaacaatcccatcaacaagtgggcgaaggatatgaacaaacacttctcaaaagaagacatttatgcagccaacagacacatgaaaaaatgctcatcatcagtggccatcagagaaatgcaaatcaaaaccaaaacgagataccatctcacaccagttagaatggtgatcattaaaaagtcaggaaacaacagatactggagaggatttggagaaataggaacacttttacactgttgttgggactataaactagttcaaccattgtggaagatagtgtggcgattcctcaagaatctagaactagaaataccatttgacccagcaatcccattactgggtatatacccaaaggattataaaacatgctgctgtaaagtcacatgcacatgtatgtttattgcagcactattcacaatgccaaagacttggaaccaacccaaatgtccatcagtgatagactggattaagaaaatgtggcacatatacaccatggaatactatgcagccataaaaaataatgagttcatgtcctttgtagggacatcaatgaagctagaaaccatcattctcagcaaactatcgcaagggcaacaaaccaaacactgcatgttctcactcacaggtcggaattgaagaatgagaacacttggacacaggaaggggaacatcacacactggggcctgttgtggggtgggggaagggggagggatatcattaggagatagacctaatgtaaatgacgagttaatgggtgcagcataccaacatggcacatgtatacatatgtaagaaacctgcacattgtgcacatgtaccctagaacttaaagtataataataataataataataataataaaatatataactggaacagcaacaaaaataaaataaataaaataaaaaattaaataaattacttttttctaaaaacatgtgggtttgtctaaacaaacaaacaaaaaatcctcttcctttctcaagaaaaggaaaaacatttataaccatgttccctggaatgtaaagagcccaccttccacattcacagaaacttaacttattaaatattgattcagggcttttacattttttaacacaaaaattatgataatcaactgttaaatagacaaatattgaatagatcacttttttaacttttaatttttaaataattgtagattcacaggaaattccaaaacaaaaaacaaaaccatgtacagggaggtgccttttaccgttcgtccagtttctcccaatgataacatttttgcataactattgtacaatatcaaaaccaagaaaattacattggtacaatccacagagtttatcagatttcactagttttgtaagtacatctgtgtgtgtgtgtgcgtgtgcatgtgtgtgatctgctgtagatctgtgcaaccatcaccatgaagatacagaactgctttatcactgcaaggctcccaccaccactacctctttatggcaacacccactctactccaacctcccatccctaacacctggcaactaccaatttgtgttccatccatctctacaattttatttcaagaacacaatataaacggaatctgatagtatgtaactttttttttctttttttagacagagtcttggactgtcacccaggctggagtgcaatggcatgatcttggctcactgccacctccgactcctgggttcaagggattatccttcctcagcctcctgagtagctgggattacaggcgctctccaccacacccagctaattttttgtagttttagtagagatggggtttcactattttggccaggctggtctcgaactcctgacctcgtgatctgccagccttggcctcccaaagtgctgggattacaggcatgagccaccacgcccgtccgatagtatgtaacattttaagattggcttttctcattcggcataattaccttaagatacatccaaattgttgcttgtatcaatagttcattccttcatattgctaagtaatattgaatggtatggatggaacacagtttgtttaaccattcacccattgaaggacatttgagttgcttccagtttttgatattacgaataagctgctaagaatattcatgaacaggattttgcatgaacataagttctcatttccctatgataaatgcccaataatgcatatttactgcatatttagttttcttttaaagagactgccaagctgttttccagagtggctgtgccattttacattcccaccagcattgtataaattgatccaatttctctgccattctgatagtagtgatatgttttctatagtgatgttttcatggcaggtaggtttttaaaagcttcctctcattatctctgataggttatccattaacaatgatggaatatgcttcttagaaaattttttacatcaacagataaaattgtatgtatttaccattgtacaacatgatgttatgaagtacatataccctgtgaaatgactaaatctagctaataagcatatgcattagcttacatagaatactcttaacctaaataacagaaaatgttttgtcactactgatattctttgcactttgaatgagaaagcatgtatattcaaaatattgttctggttttttaaatgagaaaatgtatattaggcatgtttcatgtacatttaaatgctaaattagtgtaggctattagtagtaaactagtaacagtaataatagtggtaataattttagtaggaagagtggtagtagcggtacagcactgctaaaccctccatggtacagagtttctgtaggataaaaataagtagttaattctatgtacctggaaaacaaatgcatatttattttgcaggataaagttctatagtaaaccaagtttgttaacacttgttaagaccaagcttattaaccaagttgtttaacacttacataaccttattaatattttttatttgaatgtgcatttgccaatttctccctaaaatcctatccatgtttactttccatatttcaaagctttattgctagcacatacaaattcatgattattatattacttttgtattgtttcttttaggacaacagatatctggtgcatctcttttcatcactctattgtcaatattcctgtgttattttgttttaaatgagtctcttgtaagcaacattaatgtgttttttctttgtgtccaaagtgataatctcttttttatgagtgactttttagagaaatttcctacatatcaggactcatttctactctgatttggtattttctatctcatactttgtccatctttattcctgctttctgttgaattgataacattttctatacttcttcccgcaagcacacccacaggcatacatgcacatgcacacatacacatgtacattgtttttctcttcatgtttgagggctataaatttcctctactagttggaacctatagcataataatttgtaagatcatattggaagaaatggcagaccaaatatcatttgggtaaatcaaacagggattactgctctaaaggatagggaagaaagccatcaaaaatagaatttacagaaaaaagattagcaacattctctagaagagatagcagttcaaactttaagaccccaaaacttcacctgtatggataataatgtctacctaattaaaggacatatcagaaattcagtcagcataaatgtccttctcctggtccatatgctcatatgccagtcaggatctgtggatgtgggttgacaaggtacaggtggatgacaatctggagtcatgaactatgtaatatggcagggtatagaatagcacagcacactcagacacaaccacagcccggacttgtcaccttcaacctcaccaatgaaagcctcatccaagtatatttctgaattcaggaagtggaatttacacacagatatttaggtatcatggtaaaggagattctagctaatctatagaacctaactggtgcatagttaactgtaagtttttctaacaaaatctgagggcattattggagacattttgtatcctccaaagcaagcaaaatctttaacatgcttcaactaccctttgaatattactactatcccgtattccttattgttttttgctagggttttgttatctcttacaaacacattctaaaagctgagttatttttataatcttttgttttaacttttaggctcaggggtacatgtgcagatttgtcacataggtaaacttgtgtcacaggggtttgttgtcacagattattccatcacccagttactaagccttggaccaaatatattattttttatgatcctctcccgtctcctaccctccacccttaagtagaacctgctgtcggttgttcccctctttgtgtccatgtgttcctatcatttagctcccacttataagcaataacatgcagtatttggttttctgttcccgtgttagtttgctatggatgatggcctctagctccattcatgttcctgcaaataatctcattcttttttaatggctgtatcatattccatggtgtatatgtaccacattttctttatccagtctaccactgatagttatttaggttgatttcatgtctttgctactgtggatagtgctgcaatgaacattcacatgcatgtgtctttatggtagaatgctttatattcctctgggtatataccaagtgtattagtctgttttcatgcagccgataaagacatacctgagacagggcaatttagaaaagaaagaggtgtaatagacttagagttccacatggctggtcatacctcacaatcatggtggaaggcaagttcttagagacctacagagagacttagactcccacacactaattgtgggagattttatatgctccactgtcaatattagactgatcaacaagacaaaaaattaacaaggatattcaggacttgaactcagctctgggccaagcgcacctaatagacatctacagaactctccaccccaaatcaacagaatatacattcttctaagcaccacatcacacttattctaaaattggccacataattggaagtaaaacactccccagcaaatgcaaaagaacagaaacaataacatacagtctctcagaccccagtgcaatcaaattagaactcaggattaagaaactcaccaaaactttacaactatatggaaactgaacaacctactcctgaaggactactgggtaaataaggaaattaaggcagaaataaataagttctttgaaaccaatgagaacaaagacataatgtaccagaatctctggaacacatttaaagcaatgtttagagggaaatttatagcactaaatgcccacaagagaaagcagggaagatctaaaatcaacactctaacataacaaaagaactagagaagcaagagcaaacaaattcaaaagctagtggaacacaagaaataactaagatcagactggaattgaacaagatagagacttgccattcttgacagaaatagaaaaaataatcctaaaatttatatggaagcataaaagacccagaatagccaaagccatcctgagcataaagaacaaaactggaggaatcacattacctgattgcaaattgtactacagagatattgcttcaaaaaatcaatgaatccaggagatggttttttgaaaagatcaacaaaatagatagaccgctagccagactaataaaggaaagagagaagaatcaaatagatgtgataaaaagtgataaaggggatatcaccactgatcccacagaaatacaaactaccatcagagaatactaaaagcacgtctatgaaaataaactagaaagtctagaggaaatggataaattcctggacacataaaccctcccaagtctaaaccaggaagaagtcgaatccctgaatagaccagtaataagttctaaaactgatgcggtaattaatagcttaccattccaaaaaagtccagaaccagacagattcacagcctagttttaccagaggtacaaagaggacctgataccattccttctgaaactattccaaacaatagaaaaagagggaatcctccctaactcattttatgaggccagcatcatcctgataacaaaacctggcagagacacaacaaaaaaagacaatttcaggccaatatccctgatgaacattgacacaaaaatcctcaataaaatactggcaaaccgaatgtagcagcacatcaaaaagctcatccaccatgatcagatcagcttcatccctgagatgaaaggctggttcaacacacgcaaatcaataaatataatccatcacataaacagaaccaatgacaaaaatcacatgattatctcaatagatgcagagaaggccttggacaaaattcaacatccctttatgctaaaaactctcaataaactaggtattgatggaatgtatctcaaaataataagagctgtttatgacaaacccacagccaatatcatactgaatgggcaaaaactcgaagcattccctttgaaaactggcacaagacaaggatgccctctctcaccactcctattcaacacagtatgggaagttctgggagggcaatcaggcgagagaaataaataaaagatattcaaataggaagagaggaagtaaaattgtctctgtttgcagatgacatgattgtatatttagaaaaccccatcatctcagcccaaaatctccttaagctgataagcaacttcagcaaattctcaggatacaaaatcaacatgcaaaaatcacaggcattcatatacaccaataatagacagagagccaaatcatgagcgaactcccattcacaattgctacaaagggaactaaatacctagaaataaaacttacaaaggatatgaaggacctctgcaaggagaactacaaaccattgctcaaggaaataaaagaggacacaaacaaatggaaaaacattccagactcatgtaattagattaggcctatgccctgtcatctccgttttgccagattactgtaacagtcacagaagtaacactgggcagtaaaggtcatgggaaccactttaaaattcttcctatgacatttttttctgttgttccatttttttctgttctattgtgtttcagaacagattactttccttaaataaaaacctatttatgaaaagtaaatatatgtaatattttaaaaagtttctaattatcttatgtttaaaatggaataataacagtaaccagtcacaggattggaattaggaccaaataaggtaatgtatatgaaacatttataaactttgaagctgtcagtaagcattagttatacttaatttaacttttgtctagattcatagagatgaaaaagatagtcaaatggtcatatggtttagtagtttctaaagttttagaaattatagaatgtctcctaccatgctattttaatatcacaatagatccttgaagtaagggcagctatcatcaatatcacatatttttacttggtttcagtgtcttgaaatttcgtagaacaggtattgcaagatatttcaaaaactatctttttttcacacaaagaatttaataaaaattgtttttaatacagcatttcgaacatgggaaactcaaggatggcatgacagatataatatttcttacaatatgtctgaaatatatgtttgggagagagaaaatgaagtcaacattccagggctttgggacgtctatcctcttaggagggagatggctaatgtgaaggaataataacggaacaaaaggtcctagcatgttctgatgggttccacttggttcagacaaccaaaataagtgattaagtcatgtctcaaatcattgaggtttattgagccagcttgagggtgcaactgggaaaaaactccagtcacagaagcatctgtggccattttttccaaagaggttctcaggagatttagtatttatacgttttccttaaaaaggggccaggggtggcagtgagacaaatgattatatacttctgagactttagtcagtgcccagtaaatctacattctatataaggtaaggtgcatcttggggatgggtgaaggaaggattaattttatttttgttacctacctgggaagataagctagtggtcttttgaaagaactggtttttgtttagtccttaggaaagaaaacctaatgactcagctaggaggagggtataatgaggcatgtccaatctcccatcccatcatggctgtaaattcagctttcaagatttctctgggattcccttggccaagagggagtctgttcagttagttgaatctactgatccaaatgctaatctcttcaattaaccctctcacagacacacccagaaataatgttataccagctatctgggcttaacctagtcatattgacacaaaattaaccatcacatgttctttacctgatggacacttccaaggtacaatgattctatggaggcagtcttgattagtccttcataaggaacaaatttatattttctttaaacctatgactagctcagtaattgataccttgtatttaatttccacctttgtctgtctcacttttctttcttccacatttttaatgtcctagaattgaatgaccgaataaaatattagtggattagctttgcctaattctctgttttctggggaactcaggctaagattccttcatttattcagcaactatattgaataaatattattaagtgaatattgttgttggatgtctactctgtgccacataatgtttaaagcgcttgggatacatcaacgaacaaagtagacaaaaatctttgccctttctgagttactttcttggagagggagaaagagagagaatactaaaagtaatgaacaagtagattttacagtatatatgatagaaagtgataagagagcacataatcagcttcattttccagtttttcttctaccaatctccttctcttctcccaagtccatctctcaccatttcttttcttttcctttacactccaacaactttgaattacttacagtttcctctccctttgaggtcccccaacaccccatgctattttccatctccatgcctttgctttgcagctgccatagctggaatgacctccacatattccttttctctctagctattcagactcacctcaggatcatgttttcaggaaatcttacctgatttctttctctgctttccccaagctattttaggggttagtctagacttccataattcccttataaatatctttatcattatacactcatgttatttttaaagcataattatttgtgtttttatgttttctactaatctggatttcactgaggacagggactatgtcatatatactgttttactcctaacacataggatggtgttcagtaacattattttacataaatgactaaatgaaaatacatagtaatgaggttccagaattatgagctatggaagtccactattaaggtctcattggaaaggttaaaaaagcaagacatttggagacacaaaataagtaaagttaaagagaagcagcagcagatttggggttggttcagtgcagagttggcttcaatttatgtgctctgaattatactctgtggtacattaattgcacaaagtgaccacaattctttcccccgattatcctattgcaatgcttgcatctcttcacttcaaggtgtagagtctttttccttatctcttgaatctaggctggacttttgacttgcctttgttaaaataattcattgaaaatgactgttttgaacctgagcctcaagagacattgcactttcacttcccttgtaaactcttccctctgccatgagaacaaacctggttagtctgttatcctggaactaggctgagtcatcccagctgaaccaccagctgatgggagacacatgagcaagtcccatcaagctcagctaaatctattcacgtgagcagaactacccagctgacccagagactcatgaagaaatcataaatactacctgtttaaagctactagatttggtgatagtttattacacaacaataactattaattaatgatgtggaacttcaagtggaaagtttgtttcagagcactcattgtggtacaaagtgttttctgattttttagagagtgactttatggtgtttgtagaaatgatatgtattataaaaaagtttaagcaatatgagtaccacaaaaaagtataaaattacaccacctagttacatatttactttatagctaaatatgcatatttcaaaccatatattatgtgaaataatatatcagtttataaatttaaatgttattctctcatattttaagaaataacttaaaccctttatttgtatatttgatattaataattgttcttgattattagagccgctttttgagttgtctaacagttttccagagaatgtcattttgactgctaggtcatttggcatgtagcattatttgaagtctatctaatgctgtcactaaatgttttttctaaagtgataagtatatgtttccataataggagggaagttgtttcttcatttaccctgtaggtgatctcaaaaatgttgctattcactatattgattttaagtttttttaaaggcaaatatcaattgaatagtgaataatttttataaaatatgtgtgctgtacttaaaagttatggtacaaaaaatacctagcttcagaaatagaacattatcatcctcttttaacattgttctgatcttcctcctcagtcttttacccctttctttgccctcagagataactaccatactgaatttaatttttccccttgcttcttcttaaacttatttatttatttatatcatgagaacatttgttcctgagattcagcattgatattgtatatacctgtaattgttaactcattaatatacattgctgtttggtattccagtgtacatatagcgtgatctatttattcatttatgttggttatgaaagtaatgttaatttctgttacaatctaaacatcacatttgttaaatataatataattaatataatataatataatataatataatataatatctttcatttcaccgtccaaagtgaatcaatttttgtgtaggtggggtggggtggggggttcgtggaggggtatgaggaatgtttctgcttcatgtagtaattcagaaatctagattccttttataatgaagctcctctgtattcaatacatggctttgaggttacactggcatcatgcagtcagcagagagaaaaggatcatacagaaggcatgcttagttttaactgctgtgtgcactgtctttgatgagaaacagttgaaggcctcgttttgatgcaagtgaggatacctgacaatgtggtttatctgtgtgcttagaggataataaaattgtttgatgaatgcatagcattgttatttctacaatcttctagacactaaatatccatttaacttttattctcatactcaccttctttccaatagaggcaattgaaagtccaacctcagctaaaaattcacatccttattctgtcttcacaagcctatagcttaatggactttgttgcctcaagaattttatgtcttactgtgtggtttctagcagtgatcagatttcccattcttcaaggctctacatttcttgcccctctaatccctttcaaattccatcctgatttagttatttcctaaaatagttagctgccctctaacccttctactctctgtaatcaccttccactatgtacatggctcattttccaacctctgatatcagtttccttgccacccagcatccgactgctcggctaatgacatctatttaaggatctgttaagccaaagtataaattattatgttattcagaatagactacttattgccaaaaatcaatatgaaaatctcagtggcttaatgttatttctcactcaaatctcaggcttcttgaatggttggtgggtgatcttccctgctgtaattcaagggatcaccatcttacttcttggggcactgctattttcaacctctggcacatatagaatgcgaagagagtatgggaggttgcacgtgggcaatttgtcatttttatcatttccatccacaatgcctatattgtgtattataaaaagtgtaaaacaatatatataaagtgtttctgggagatggctttatgagtattttaaattttatttcatgtttgcttctttgcttgtcccaggattcctggaggaaacattatatcccttttgcagtaagttaaaaattataattgaataacttgcttcagaaatgaaagtatgaattttacaacatgagctaagcattaaatactaaactggttagaaaggtacatctggaaaaacctttgagtattcaaatatttcagacaaaacttgttaatatagtttttcacgaccacagatattgatctctgatttatccaaggctttaattgatagtttgaaaaggaaaatattagaaaatattaatagtattaatatcttttttatggctattttatgcctttataggtcagatgcttaattacttatttgctagatgcattcttgaagcctttgtttctatgtttcttagagaaaaatttcaaacttcattcaaaaatgtcttcatttcaatttaaaaaacgacttgatggccatcacatgcttatcacagggaagttaaagtagaagcttatgacatgtgtcttctccgaaattcctacaaaaaatgaacactattatgtttgggatgatgaagaaggaaagaaaccaattatgaaaaatcataatgggcaaattagcatttaggtgaaaaattacaggtgtggaagaattcccttattttaggattttaaaaaatgcgtccttattttcccctcctaatttggcttcttgtctttcaaaaattttatttttattgttaacatactagtgatttttgtacattgattttgtatcctgaaactttgttgacaaaactgtgtaactccactcagtgacatcagaagtcagtttatactttggcaggtactgggcaaatgttgttgttcttagcattggtcagagtggacactgcccctatggcttggtcctcactacagagtgcagctgaagcaggaaatggtctgatgcatttatgttttgtgtaggaatctgggaggatgcaagagacgttggaagtgtgattagaatatgtcccccaatttcttgtttcatttattctgaggaaactatttgtcctgttatctgggtgagacctgtaggggattggacccaaatctaaaactctgaatcaaagaagaagatgcagctaaaagaaaaaggaggaagtccagaattgagaaaagcctataggatggtggttatataatccttaataaataattttagagctaattcacaccttttagagctaagtctagtagaaaaatttgcatatatttatatgaatgttgagtagagatgaatgcttacttttaaaataatgtcttatatctgaataaaaataagagcgagactaagataaactgacaaacatgagactaaagaacgagaagttccataataaagcatctgactataaaattaatttagctatatgttggccaaatcgggcttcttgtatctatagttacatgtagtataaatatctcaccatgagactggaaacatatgacaggtaactcttatcctgacagcagtttcacaacaggatacccatctattaacaaaataattctacagagtatgactacagtgctgagtatttcagcacgctccatagatacctgttttacagctttagagtttttctttttttcttccccccgagacggagtctggctatgttgcctgcactcactgcaacctccacctcctggattcaattcaagcgattctcctgcctcagccttcctagtagctggggttacaggcactcgccaccactcctggctaatttttgtatttttagtagagatggggtttcaccatgttggccaggctggtctcaaactcccgatctcgagagattcaccagcttcagcctcccaaagtgctgggattacaggtttaggccaccgtgcccagcctcacagctttatagcttttcatcagcaatacaaaatgtcttcaacacacacattatgtatttctctctttgatttatattactgaagcctgtgaatatgtttttggatcaagaacctttttgaaaatctagtgaaaggcaattccttcccaggaatatgcatagattattgtagaaaacatacagactctacaccagaagttcttttacagactccaagttaggaaagtctactctcaatcaccattttttttaatgtcttgggaagaaactagaagttagcaaagtctcaatcctggtttaccttgttgcttttttgaaggtctggggaaatctagagccttcagtgttgcctaactctactgagggcattcctcttggtgccatctatagcaaacaatgtgatgatgggagagaagtactgaatatgaggctgcatgtctctctagagtaagaatagaacatcatctatttatgtattcatccattaaacaaacatataatagccattcattatgtagaaagcgcttttttaggcactgggggataaatgatatataagataaaccacaagaagaagcccagaaatgttattcatattattagtttatgtaaaaactagagattccaaatagtaaaaagatagaattatatttatttatactgaatggcatattatatgcataaatgccttgtaaattgtatactttcaatgctatttttatcttttaccttgatattaggaaactgaaaccagtgaacatcacagtgagcaaaggagtcatgagattttcatgcaggaaatagaatttaaaaactcacagatactccaaaacaaacctgatctgaagcagaaaaagaaattgtttatggaattgttatcaataagacttaacaggtactttctgaatggcagtatgaattgataattagcagacatcttgtttcaatatagagcttgaaaaagccagttataacaatatagttgaaaaatacagtttagtagcagcacacaggtgggtccatgctctcacagggtaatgatttaataaaaaataataatccaggaaaaaacaggtcaaaactcccagaaactttcacacatggcacaatgtattatgggagattttctaagaatattgttaaaacctgaccttgataaccaccaggaaaccaagagaaagaacattcaaattaactacaggaaatatacatttctatatgtattggtttcctagggttgtcataacaaattactacaaacttgttagcttaaaatgacagaaatgtgttctctcacagtgctggaggctagaaatctgaaatcaaggtgttgacagggctgtactccctcagaagactttagggaagaatcgttccttgcttcttcctggcttctggtggctcccagcagttctcgacagtccttggtttgtagctgcttcactccagtctctgcttctgacttcacatgaccttcttctgtctctgtcccctctttttctgtcttttataagtacacctgtcactgggtgtagggtccactgtaatccaggatgatttcatctctagatccttacattaaagcatctgtaaagacccttattccaaataaggtcacattttgaggtgctgtgtgaaaataccttttgtgggccagtattcaacacactcaactattccactgatttaaaacaatttttctaaactttgtactgtttcacatttggaagagaggatatttgtcttactatttcaaaactcagaaattattcctataagccaccaaattcaaggagtatgtgaaagtgaaatcacatttttctcttgtaacatttcagaatcttgtcatataataattcatgcagaaaggcaagggatgcttgcctagatcctaacagtggcaaaatgtgttttatgattactgcaatagaaccttccagttgaacactactatactgtaaagagatgatctaaattcatttatgtcattaagaacatcatgtgacaatagtgactgaatcttcaaaacaatcttcaagacttgcagtaaaaatgtgaattctgtttttgcttaagtgggctatgttgtatgatgaagacattgttctattgcaaatgacagaaatgcaaataaaccaattttataaagggaatttattgaatcaagcacgtaactaagaagtccaagagaatgggaatgtctttaaaaatgctatggatttaaagaacaatattttttcttgctttattgctccagttcatctttcctcttatatttggtttcatttctactggtgggttttcttcctataacagacaggctttctgtatgtagtgagggaaatagtagcatagcccacagaaatattcacggttgcatcatcccagttttgtgatatagatatacgcctgagaaaagaaacagtattcatgaatacaatttgacagaatggttctgattggtttgtgaccccaaattgggtcaccttccaatttgggggccaactatatagtcaagggattgaaatgatttgtcagagtaggcctgcaacatgtgctactgtggttggggtgtagtgcggggtagtctgcagtcatagaacagagtaaagctaatttagccatgttgggatcaaactcatgaaactactagctccaggttcacgctaaataacactaaacattttatatgttgaatttctgtggttactctcagagtattgataacaaacattcaaaatagatgtctaaataactatgcttcctctttttgagggaccctgaagtaaaatcattatgcttcctctagcttacgaatgacttttggagggcttccttctagcacttttaaaagcgtcgctcttaagagtggattaagtgtgacatttggaaatgtcagaggtaactttggctgtgagagcactgaccaataaatcttacctatacaaaatcctatttattgagggcttcggtgttcatgacattactaggcatcttttctttgtcctgtttcagcaaataggtttagcagggaagcaattcactccttacaaagcaattatcattagaaaatgtcactgcataaattgtaggataaaaaagcagaaacatctgattagtgactgatttaggagagaagagttcatgccaagtggaatagatatcaggaactcataccctgttcttcaagtctgttgaggtaagcttattagaaggatttctttaaatggtggaatggttggtaagatttttccccaattcaaacaataataggaagaaaaacacttataatctttgtttaaaagttgtcaatagctggtatgtttttatgcaattgatgcatttctgaacatagctataaaatgaattaattagtaaatcatatttattaactacttctagaaagcaaattctgtgctgacacctttacaaatgtagtattattaaaatcctcttaatagcactataatatacacaatataataattctaattgtacaaatgtgaaactccaggcaacttttgtaaattttctaaggtcaccttgctaaagtgaaaatgaggtatgtagccagatctttctgactcagtttgtcatatattaagcaagcttgctaaattttatacatctctatattggattcttttgtaagtcagtcatgttatcattcatgtgtaggtttgatggtcaataaaattaaattggattgaaattaatttctgatataggccacatctataaattttgcctctcaatataatgcaagaggtgtaatagtagctggacatcggctcatccctctttcttcgagccttactgttctttgacccaagactgcacatttaaaagagaggggagatgagtttttaacgctgctgtggagatgtattaaaatcccatttcagttaaggttgcagatttagcaaataaaaattagttacatttgaaatgtttatctgaaatttaaatttaattggacatcttttatctacaatgttaatttgagttcctccaacttgaatctctgtgaggtttgctcttgttcctcttgaattctcttttctgttactggtattttttttcagatcaggtcttcaatgagatattcctttttatttgaggtttcaagcttcaatatcttgagttcatcatcagccagcatctcctaccctgatttcttatttacagctttattctctggctcatactatgactttaagtttctcatgtaatgcatttactgttacattggactttgacaatcatccacaatgtggaaatctaaagcagaaaatgggaaggcagaacaggaaagagtaaggcacattggcaggaattaagtctagagcttcttacaagggtaaaagttttgttggataaaatgggatcagatattaggactagcaaataaaggtcaggcagttaagaaacctgggaacactggaaaaactgagaggtggatgatgcagaagatgagctggtcatgcacaatggcagagggattctcctggagcagaggtttggataatcagagatggatcatgatttgtcaggactttcaggaactgctttgtccagaaacagcccctcttagtcttaaagttacaacatcccctaaaaagacaaagtgctctgctagaatactgcaccaacaatttagagaagagctttccattcccacccacagacatgtatttggctaaatatggctcttgctaatgaagagcctgaaaacatatctgaagaaatatctactgaagttgcattatgatatgatatgtagaccgtaatttggtttgatacacaaccacctgcaagcccatccaagacaaaaagaagctccagagaaaacttaatgtagcacggcctcacctgtaggagatgccttaaaatgaatgcatgaccagcacaatagtgagaatacagcatttgtattctcattcttaccactatgtctttgtgtgttttacacacacacacatacacacatgctccacttttatccataaatataaacacacacacacgctccacttttatccataaatataaatcttaaatacaaatttaaatttgaattgtcctgaatctcctcatttactgctgaccaatttccgtattaatctagtttccactttggtaaatgactttgtcctcaaatttgaattctcattctggcttttctggataggcatatacatctgctttctctgattttagattcagtttcttccccaaagtttccaaatactggatattcataaatcaaattgtatagataatttaggactatcatctataacaagaaatatcataaaattagagtgttgtaagtcaaattgccagagggtcagctacaatccaccactccataggaaccctgagaataagaattccatagttgtcagtaaataagattacaataacaacaagagattattttcaaaaatcatgaaatcaccaaaattctatctgccaaccaaacacactgctggttcaataatctttgttgataggtctttaatttccttacatgagcattctgcaaaatgctttaagaataactaagtgttatacaatgaactttgggagtcagccagtagaaaattaaatagaatttagtgtgactaagtcactgtgacggaatttaatgctttaaatttttgtgaattatgaggaaatttcacagggggaacatgatggaatacaagtactcatagccctgttaactgcagctagagcaggtggaaagtgtcaagttgggatcccagtggtacagaacaaattgtgaatcatggcttcttcctgttaaaccttgaatcacctttaggataaagtccaaaattcctaacatgatctttaatgtcagtcataatgtggtcccctgtatttctttgtatcattttctctcgccacttactccgcaaccatgctgatctattgatatacttgccatttcctgaatttgaggtattcttctttaatcttggttttcatataatctatttctctgataaaacaccatccaccactctactcaacacctagttaactttccagattcagtttctttgtgctgcctctgttcttatccctggattaagaattatctcacaatatgatggttgctctcttgcttgcatatcttctatatttgtttttgagtgtcttttgaaagagagtgcctcttatgcttcattgtaaatctagggcataggaaatttcccagctgacagcagtcatttaaaatatactttttgaaataatgaggcaagcaaacataggcagactcagctgctgcagcttggaggatgtctagttgatagaaagaccacggaattccaagggtacacaaaagtaattcaaacataatggctccagtggacagcctctgatttttctttgtataatcttaaaaaaaagctcttaagcagcactttatcttatattttacacatgcgcgcgcgcgcgcgcacacacacacacacacacacacacacacacacacacgcacacacacccttcttctctctacaacctttttgtctcctgtaagtagttagggagaggagaacacctgactgtgtgaaatatgtgtgggtggaaatacaaatttctaactgtccctctgtaggtatttaggttccatttttccactctgctattaacagttgcctttcatgtctctattttccagcttaccaaatttgggtgacatattttttctggtatgtggtcctctcccattctctttgtgcttgtggatttttaaaaaataattccttcattatttgtgggaaacaatagaaaaaatgtgaatttatttcaccaagtttaaatggatcttttctgcttcaatattttactgatttttactttgacaaacatagctttgccctcatatttaagaagttttgagtggctgtcaataaattctgcaactggttgccagggatgacaatatcatgtgtggtatgcagaagctagcttgcaaaagctgatgataattaaattgttaatttttctcaagctttgtgagccagttgtatacacagccattattaaaatttatattacatagccttattattaaacgtatttaaagcaaagttaagatagccttaaatctcatcacttcttaattattttactattttctatgtttttgaggatatttacatatattacatctataaagtaaaaataccaaataatagtgtattatcgtgtatttctgcaaagtgttatcacattgttggcttataaattggccataatgagagtattaatgccacaggaatctgcaaatgctaaaaatcaagctattttttattcagaaatctagttgttagcagtatgccattgttatgtatcctccaaagttaagaagtcaaagcactcctaatctgcatccatcaccttttatttagatatttcccatagtcttgagatttctgtctcaatttcctttattttcttcttccttctatttcattccctgttttcctcagtcctacctttattctatcttcatgctcttccttttcttccctcctttcttcagaagctaactccatgtaatagatttagccactcattggccaaggtatggctgtgtttgaaatgctgttccctggtgccataaagaaatagcacttgaacataaatttaatttcctcagcaaggccatttgtatactttctgcagaaagggtatatgcaccagcagttttgccatgagagtacactgaacaaaggagacaggctcatttataacctgatgcatccaccctactgctgtgtccagtttccattggctggaataggacctcacattctgtatttgtcccgattggctagtaacttagaactttttaaaagaggcaaaggcggaggagaacaaaggaaggaggaagtaacttgtggaatgctgagaaaggtaaaaacaccttcaaataaggaagaggaccaggctatgacctaatgcttgcttgaacgagtataagcatgccagggcaaatatttaggctaacttgtgggagctaagaacataaagtacattgatttctttattacggctagcagatatttaagaatgttagcacaggtctttgaaaaaattttgcttctaagagaggttactatttattcctaattagatgaggaggaaagtctttgaagaggaatctctactttactttttacagctggaaatgggcagttttcctggaaccagagcatccccaagtgttcctctactgctgcttccaacttttagaaccaaggaagttcaccataacctttgtacactctgccttggatgtcatggttttattcttcaaggtttctcagtgtgtttgtgccagttttcatatactctggattctcacccctcctcactggctcatgttgcttgggtctgaaccttctcccattaaaactcagaaaaaaatgaatgagcatttcatatattcttagaaaaattctgcttcagttgcaggacaggatggaaataatgctacatgtcttttaaaagagctttcctctgccaagtggcacctgattaatttacaactttcatttaataaaacaactggattgttgttccacatgatttgtcccaaagctttatctgttgttgatgtaattaatttcttaccagttctttccccacttcccatttccagacaaaaatatctactacaactaacaatgactaaagtaccttccaagtttcagggtttctattcccattaatctcactgatatccttattactttgtttatgaattatttaaaagtctatatatgttacagaattgaaattcaagatgagatttgggtggggacacagccaaaccatatcagtcatctttctttactctatacatattccccccgaacacttacttaataatttataataaagcaagtacacaaataattcaaaaagtgagttaatttttttttttttgtaaaatccaaagcaagtaaacaggaaccacatttgatgtttaaaaaaaatgcatgagattaaaataactccttttcagaaacagaaatggaatctccaaaagtaaaagactgtttctatagatgaaggaactaatatctagagataataaatgccttttgaaggttgtacagcagatctaaggaatgaacccacaatttgggtttgatgtttgtttaattgtaatattaatctactttactagcaccattaatttatttgcaggatcttaaatgtcaagctaaaattaaaaatatcttttttctttttatattttgtctttaaaagtatttttaatttactgctaaaaagagagaatggcattgattcttcatctgcatagaaaacagctcactcccttctagcagatttattttgaattatataaacaccaaaaaaaaaatcctcacatacgctctgcatttttatagcttctttttaagcaaactctctcttcttggaagatcccctcccttcttcaagatatttctgctcctcccactacctcaaacgtaactgctattgttgtccttgttgcatccgcatcaccctgtgcctctattaaaagcactttacacctcataatataatttaatacatgtatgttcccctaataagatctaagttcctctaggggaggaacatatcttaggcatctttgtagaaacagaatcagccacaggatctggcacacagtaggagctcaacaaaagaatgttgaagtcatgaatgtgatagtaatagatactaaattgttctcaatcaataaatttttatttgggaaaatagagcatttggaaagaatatttcttaggatttttttcacctgcaggtaacgtaaaactgaaaaaaaaaaggtttaaatttaaattaaaacgtagaaatgaatttgttcccttggctgaaaattccaaatgtgaggcagctctcaggagtaatttgagggtgcgagcctcaagccttggcagcttccacatggtgttgagcctgtgagtgcacagaagtcaagaattgaggtttgggaacctccgcctagatttcagaggatttatggaaacacctggatgctcaggcagaagtttgctgtaggggtggggtcctcagggggagaacctctgctagggcagtgctgaagggaaatgtggggtcagagcccccacacagagtctctagtggggcactgcctagtggagctgtgagaagagggccaccatcctccagaccccagaatgatagatccactgacagcttgcacaatgcacctggaaaagctgcaggcactcaatgccagcctgtgaaagcagctggaagggaggcagtaccctgcaaagccacaggggtggagctgcccaagaccatgagaactcacatcttgcatcagcgtgacctgggtgtgagacatggagtaaaaggagatcattttggagcttgaagatttgactgcccttctggattttgggcttgcatggggtctgtagcctctttgttttggccaatttctcccatttagaatggctgtatttacccaatgcctgtacacccattgtacctaggaagtaactaacttgtttttgattttacaggctcataggcagaagggacttgccttgtgtcagacgatattttggactgtggacttttgggttaatgctgcaatgagttaagactttggggggctgttgggaaggcatgatttgtcttgaaatgtgaggacatgagatttgggaggggccaggggatagaataatatggtttggctgtgtccccacccaaatctcatcttgaatttctatgtgttgtgggaaggacttggtgggaggtaattgaatcatgggggcaagtctttcctatgctgttctgatgatagtgaataagtcttatgagatcttgctggtggaagggtttatggggtgccagtttagtcagtcacccctgtgtaggacacctctggaacaccatagggggcacctgaggagaaacatctcattattgccattgtgcccccaggccagtgagcatgacctgctctgtggctttacacagaatgctctgggcggaaacactcccttgaagcattggaatgtgaccagacatcctatcctagctcccaccagctgcagcctggtaagttaaagattatcatagtggttagacatatgctttgagcttaaaggaaattcacataaccgccagtgctatacatgtttccaatgacgcatgctcccccaccttcaccgtttcaccccgtaccatctgcttcttagatcaaaaagattgtactcaataaattttcaggaaaccagtgttctgggccttctgcagccttcactctagcagatggccccctggacctgcttttactcttaacttgtcttttctcattcctttgtcactgccggactttgggtacccatggctgggggttgggactgatctccccaacaggtctgatggtttaaaaacagaaatatccccgcacaagctctctctttgcctgccatcatccatgtaagatgtgacttgcttctccttgcctaccatcatgattgtgaggccttcccagccatgtggaactgtgagtctaattaaacctctttcttttataaattgctcagtctccagtacatctttatcagcagcgtgaaaaccgactaatacaatgacttaagtattagtaggcccttcgtctattgttgttgttaatatccttccttatataagaatgatgctcttaacttctcaaaataaggcatatactttgacatattgtagtgtttggtttaaactgagtgtttcattgacccccatttattttacatggcagtaaaagtcagtgaccagggaacggaataaaaataacttattgctttgctcagaattattgtcatgcaaagacttcttcattagggacacactcaacatcccttcttcacttcttcttattaagagacctctaatccactttgggaggccaaggtgggtggatcacgaggtcaggagatggagaccatcctggctgacatggtgaaacctcgtctctgctaaaaaatacaaaaaattagccaggcatggtggcaggtgcctgtagtcccagctactcgggaggctgaggcaggagaatggcatgaacctgggaggcagagcttgcagtgagccaagattttgccactgcattccagcctgggtgacagggcaaggctccatctcaaaaaaaaaaaaaaaagaaaaagagacctctaatcttatgaatccagttataagtcaacatttcctagggtttcttttttcagctagatatggccatatgattaaattttaactcataaaatacaagtagaagtgatatatgggattttcccaagttttcttaagcaagaggtcacatactttttcttcttcttaccctcttgcttgctatgtgtaatgtggctggagctcgaactaccattttggataaagagtaataagataagaatatcaaaggttcaatagaagaaatctagatttctgtactacctatctctagattttaatgaaataggaattaacttctattttgtttaagccattttggttttctgttaaatgaaccagaatctaagtcttaacaaacactgtgggagatcagtgccaaatcctatcaggtttttatcctgtatttcttaaatctgtccttttctccctgctttctactctcatccttctcatcatcaccgccaccaccaccattacctttagcctgacacatttactgattgcctagactactgcaatggttttctaactggtctacacaattcagtctagacctctccagtctgttttccactttgctgtctaactaatgttttcagaattcatattttgaagatcagattattacccactcttcttctagggtgaaactttgcagatgttttctaattacaattaggatggaggctacaatttttaacatgactgtgttggttagctagggttgtcataacaaactgccacacattaggggacaaaaacagtagacattaattttcttataattctggagactggacgtccaagatcaagatgtcagcagggttggtttcttttgtgcctctctccttggcttgtagatgatgatcttttctatgtctctttcctcagtttgtgtctgtatcctaatatcctcatcttataaggacagcagtcatattggattaagaccctccctaattaactcatttcaatttacttatctctttaaagattccatctccaaatatagtcatattctgaggtactagggggttagaacttcaacatacaaattacaggaaacagttcggccataacaatggcccataatgtttggttcctgattccatgagtttgtaagactttgaagttcccatgcactagaacactagaaaaacttgtttatcctataaatttcctgggcaagggagagcatcaccttcataaagtctcagtaggaagactaaatttttcctcaaaagggagaaatttgaaaagaatacttatagtgtggtctgggcagggattggttaacaagtttatcaactaggcaagttactggagcagtgtttctattgttgaaacatatgagtctagtatgagtttgtgttaaaagtgttaaagtgaccttatgtcttctgtgttgtatgctgtggttagtcctgtaatgatgtttaactgttttgagagtcacagtatagttctactatctctgttttctgtacttttctgtttattttccagtgtccctccctccttagcctaagctaagggaaaaaccattatctctggatatgtgattgaattggatctataatggtattcaatgggttgtgagtcattttgatatctaatagtgtcaaggccagatttcttggtctttttgttagaatgatcatctgttataatagtggctgcacaacagtgtttaagacacacttgcatactgcaacaccaagatgaagacaatgattactattagagtttgcaaagcaactatgaagctgtgattgtagacttagaatatcatgaaaacatgttcctagtttatttgtatttttcttatatacgcaagtagctttccctttaatttagatattgatttttcacttttgtcagtgtctgaagatttagtcccagatttggttattgtcaaggataagggtcttgggagtaccatgactaaaggtagaggtacctattaacaatttagaacctttaaatagcagacaggaaagaagatagcaaagaggttaagcctagctttgtcattcacatggatatgcgctaggaaaatcactgattctcttttatggagaaatgtctgttctcacactgctataaagatactccctgggggccagttgcagtggctcatgcctgtaatcccagcactgtgggaggccaaggtgagtggatcacctgaggtcaggtgttcgagactagcctgacctgcatggtgaaaccccgtctctactaaatacaaaaaattagccaggagtggtggtgtgtgcctgtaatcccagctacttgggtggctgaagcaggagaattgcttgaacccggggagtggaggttacagtgagctgaggctgcagcaatgcactccagcctgggtaacaagaacaaaactctgtctcaaacaaacaaacaaacaaaagatactacctgggactggataatttataaaggaaaggggtttaattgactgacagttctgcgtggatgaagaggcctcagagaacttacaatcatggcggaaggtgaaggggaagcaaggcacatcttacgtggcggcgggagagagagagagcaaggatgggggaactaccaaactcttttaaactatcagagcttgtgagaattcactcactattctgaaaacagcatgggggaaaccacccccataatccagtcacctcctataggacccttccttgatatgtggggattacaattcgaaatgagatttgggtggggacacagagcctaaccatatcattctaccactggctgctaccaaatctcatgctcttttcacatttcaaaacaaatcatgtcttctgaacagtcccccaaagtcttaactcatttcagcattaattcaaaagtgcaagtccaaagttttatctgagacaaggcaagtcacttccacctatgagcctgtaaaataaaaaacaagtcagttacttcgaagatacaatggctgtataggcattgggtgaatgttcccattccaaatgggagaaattggccaaaacaaaggggccacatgccccatgaaagtccaaatcctgtcaaggcactcattaaatctttttttgtttctttttttttttttttttgagatggagtctctctctgtcacccagactggagtgcaatggcatgatctcatctcactgcgacctccgcctcctggggcaaagcaattctcctgcctcagactcctgagtagccaggattacaggtgcctgccaccatgcccagctaatttttgcatttttagtagagacagcgtttcaccatgttgaccaggctggtctcaaactcctgacttcagatgatccacctgcctcagcctcccaaagtgctgagattacaggtgtgagccactgtgctaggtctcattaaatcttaaagctccaaaatctcctctgactctatgtttcacatccagagcacactgatgcaagggatgggctcccaaggccttgggcagctccactcttgaggctctgcagggttcagcccgtacagctggtacagctggcattgagtgtctgcagcttttccaagtgcacagtgcaagttgtaggtggatctaccattctgggatctagaggatggtagccctcttctcatagctccactaggcagtactccagtggagactctgtgtgggggccccaaccccatatttcccctctgcattgccctagtagaggttctccatgagagctcctcccctgaagcagatttctgcctgggcatctgggcatttccatacatcctctcaactctaggtggaggcttccaaagctcaacttttgtcttctgtgcacctgcagtcccaacaccacatggaagctgccaaggcttggggcttgcaccatctgaagcagcagcctgagctgtatgttggccccttttagccatggctggagctggagtggctgggatgcagggcaccaagttctgaggcttcacagagtaacggggccctgggcccacaaagccatttttccctcctaggtctctgggcctgtgatgggagtggctgctgtgaaagtctcttacatgccctggagatatttttcccattgtcttggctattagcattcagctcctcattacttatgcaaatttctgcaactgtcttgaattccttcccagaaaatgggtttttaatttctactatgtggtcaggctgcaaatttcccaaaacttcatgctgtctttctcttttaaacatgagttgtgtatggtggcctggtattcaatctgagaggtgggagtatgttagcaggacctcttcttttttcactgagagctttttaaaaataaattctgctctcctcacctttcgatgtgtctgcatgcctaatctttcctggtcacatgacaaaagcctgattttagctgaactaaggagcaaaaacttctgcatcaaaagctacctccaagtaactaaaaattggcatcatttccctaggttttatcaaagagaagaaaaattgacataatttccctagagtttataagggtttacctttctctgataaacaattttgcacctctacctcattcaacccacaagacacatatgaaaatctctgtggaggagaaagggaggatgctagaatatggacttcagtagggaggtcagtgcttaaggtggtaggttgttcccattccttttgaaaggaaagaggctatgggtacgatagacttcttttttttattcttcctgaaacaatatagtgtaacagctatttacatagcacttacattgtctcaagtattacaagtaatctagagatgagataaagtgtatgggaggatatgcataggctatatgcaaatattcagccattttatgtaagagacttgagcgcctgtggaatttggaatcctccagaggtcctggagccaatcccccatggataccgagggatgactgtacatcatactttcatttatttaaaattatatgtattaggttggtgcaaaagtgactgtggtttttgccatttttttttaaagctatggcaaaaactgcaattacttttgcaccaacctaatataaatcctacgtcacttttcatcagcaactggtaaaccaagaatcagggaccatcctaggcaaagagaactagaaagattgttcttgctcttcagaacagttgttcaaatgataccctgtggatctgattccattataatttcccagggtgcttattaaataagcagattactggatctaccacagattcactgaatcagaatttagagctgaggctagaaggctgcatccttagcaagtgcctttgatgactcctatggttcctgatgttttataacctttgttccagaaatccacactatctaacacgagacaatataacatacatgaagaggccacaaaatagtgagcaaaatcattttacagactataaatctttttattacattcatggcttagcccaaggatgaacccatagtagatgcttaatatttgcaagtaataatgagatagtttatatactagaacactgaatcatcatggtgacctaagtatttggaatttttaacatgacatcttcagttatttttgatttcaaagaaaagagccactccttactttttattttgaaatgtggcataaacctgtttgattttcacaattttaaaatgatgggaaaaaaattgaaaggttttgtgggagaagaagtacaaataggtccataaaatatgtctaagattgacttgtaaaaaataaagagaatctctaagtgccaaaagttttttctgtgcttactgacatatctttaatctcacaaaatgctctaccccgtggaagagggcagcagatataataagtaatgtattaatcatttatttgaaactctgttgatcctagtctgacaaaatgaaataaagattgatccaatttattaaggcctatgcctgctagaaacagaggcttaatgaaatatggtttatttttctcacataacaactctctaggcaggtgatggtgggtgttgttagcctctctctggtgtcatccagaatccatatccttgttatgtctgctccaccatcctcatcttgtaatttttagttttaggtttatcatttcatgggcttaaggtggctgctgcaattcctggctttatgcacatgtttaaggctggagggagctagcaaatgtgccattttctgtttttcttttttttttttttttttttgtcaacaaataaattttttcctggaaactctaaactggtatttgtttttcgacttgtggcccttaggtcagaaccctgtcacatggctacccattacggtgagtctgggaaagtgagtatccagctttctgaattctaaagtgggcagcaatggaagtagcagttgcaaaatgacttctgagttggctaaaggacaatgtctgccacaatattctctcattaccaatgacccaggacttggactctttaagaacaggagagctgagagctgaactactggaagggtagcttcactgctatgttaggcttgcttcttcacctgaaagttctttcagaatcttggttgtgtgttacctgctgtgcattctagccctgcacatgatatttgtctcctagactgactgcttcttattccttttccctttctggtaagcagtataggttagtggtggggagtgcaggttctggaagcagaaagtctgggtttaaatcctggctggcctacttattagctgtgtgatcctgagcaagttatttaacttctgtcagtctttttatcctcattcatcaagtataaatagcagtggtacctatcccacagatttgttataaaaatgcaatgacatcacctcataaaagtatatcatgaccatgctaagcatgttaagtggttggaaaatgttaataattattattaatttcttattgttttgactcatatctagatctatcaatgtatgtaatcacaatgcttggcacatagaacacacagaactcagctcacttttttgtgcataaagatatgtaattatgtaactttgtgtatgtgtatgtgtgtgttatgtttgtgtgatttgtgaaggtgttgtgcagataaaatctttttacagaaatgcccaaggcccctggatttctgcctcttagagaaagattattcaagtggactatatttgcaaaaccaattttctaagaaaccagatttttaaaaataaatttctaaaatccctatgttgtcttttattaaaattatatatttctcttggtcttttagtatactgtacatagactgtgttattttgttagattttccccagttatttctttttgggggagcagatattagtaaaagataaaatggcacccaagaatatttttcaagaacaaaatacatggcttaagaaaaagaataacctgtctgaggaatggtaggaaggacatttggaaatgaacatgcctcagtgttgaggaagatgctgaccagaaatgtgtaagcaatctggagacaaactgttgctttctttataattttactcctattcagttctggtttcatctttccattaatacatattcactttataatgtagggagcactctttcttgcctttgggatttaagtaattgaagttaatctttttgaaagagatctcagttggattgatctaagattgaaaaggtcattaagaggaaattaataaaagggaactctttaaggtgggtaacgcaggtattatagtcttagcccctggaatatgacccagtgggcagagtaagccctggcaaagcaaggcacacagccaaatgttagcttttcacatgcaaaaacaggattatgcaatagtacagactttgcaagtctattgtttacagaaggaattaagcaacatttgtttacctacttcattattataccagcaatccagcctgaaggacttagctcatagatgtcttctgaaatgtggaagaaatactttcgtttgtcataaaacctcagcaggagattggagtctggaagagggaggggagaagaggaggacctcagggaggcaagttaaacagtccagtttttgcatcttaatttccttctctgtgcttttgtctttcaaggggtggtgccgggcacaggtattttagataaataagtgggatggcaagagaaggacctttttactgcttacccatttattgggtgacaatccagtatgctgtccagaatgcaatatttttgagagtaaaagaaatcatactgggccagatcataaaacccagcattttttagacaaactgatatagtgtatatggttaacttactttgtacgaagaaggtataacaaactcactttagaggacagtggtacagtctgatagagtgagtacccagttaactctctgtgtgttatgtcagctggctttgtatcaggaagcttctggtgagtttaggtgaccccttagcagaggcaggtggaaaattccaggctaggaggctggatggagtagatggtaaacactcaagggtcagtggtctatgatgagagcacaagccaagaaccaaccatgaggattccaaggggagcctgggttatcagaagccattagagctgcagtgaccagattaaaaaggacattgccccaagagtgtctgcatgaaataagggatatccttgcttgtttgtgacccaaggatatgtaagccatacatttttccctttatatccctcaatgttagagagagaaacagaaaatatggtggctatatgggatatgaaatatttgtattaataaaaatgttaatagaaattgcatggccttttaatttatggtgtgggactaaatttaaactacaaatgtagttgagtttctattttgtggagagattatttatgaacaaaataaaggagttacaactctttataaataagtcatactataaaatgtgtgaccctccttgttgcatttaaaaaggctatatattttttgatagtgagatcttttccctctgtatttctctccaaaaatcttaataatgtcaccattttattaaatcatttgataggatcaatactttatatgaactatctcatctgagcagccccaagaaacctgtaaaacaggcattattgtcctattttataggtaaattagccaaggataagataaatcgaagggattcatcaagttcacctagataataagtggtagagcttggatttagaaccaagccaaaacactcacatggcttacctattacttttcattctaagcggccttattttatcacaaatagattgagatgaatgcattgaacccttgacttctaaactctcttctatatgattttaaatttagttaattactgaacatttcatattcttatatctgctcaactagattcaaaattcttcagtgcttccttttttaatctctgtgtttattgcattattgttgtctttagacatattcattcattcaagaagtatttattgagcacctattattgccagaaactgtctcaagtgtctgatatatatatatgtatttatatatataatatataaaaatataatatgtaatataatacataaatttatatatatataaaaatacataaaactgacaacaacctttgtccctttggaacttaccttttattgatggaggcaaaaaataaaatgagtgagttaattttaagatatagtagaaggtattaagtacaatgcacaaaaaagtaaagcagagttaagtgaaattgagaatgggaatgggttactattttaagaaacatgataagattaggtccattgagaaaatttcatctgaaaaatgcctgagggaatgtctgtgcacatgttcagaggaagagcagtttatgtggagggaagcaggcagtgcaagaggcttgaggtacatgtggccagaatagaataagtgaaataaagtcagagaaagaacaattttgggtgttgtctgaatagatcttatgggaacttgaaagtcattgcaagaaatttcacaagatttcaatgagataaataacttcctatttcttattaatatccagtatggctataagaatagacgttgctataaaagcttttattgacacatgttgacatccagacatattatgctgacatttttgtttatgaaccacagtctatcatagattattaacaaattattggtttatgtactcagatactcagacagtgatttttagttaccagaccacggtaatcacagagtttctccctgccatctttggttaactgatatgtatcaattttattttattttatttttttttttaccatcacatacctcaagatctggtaacaccatgggaagattgtatttcaagagttttcttttattttttttttcttccctcccttaacattatgctaagtaatcaggaagaaggagttaagggagcttcttttcatggactagactctagggaaaaaagattgatgatatttggtagaaggaaaagtcttatctctaaaatgccctcagtattatgtcaggctaagcattacctgtggcaaacaaaactaggatgatgagcttcatgcttggagaatgtctcttaagctatgaaatcctctgagcctccattagagacctcatcccttcttaacaagaagggtattccagacccagcaaagaagggcttcgggagctactcttgacatcccagtcctttccctgcttgtctgatccttttatttgaaattacttagtagattgaggtactagttaaagcctctgattcatgttagtctgttttgacaatctaatcctgtgttagcccagtgatagagggaatcttaaaaaaatgttacttctaagaaaggacaaaatttggcacaggttcatagactgttgtttataaattcaagggcttaggtatcttctgaataacagtattttggaaaaattgcactctaaatattttgagtggagtctgaagataaatggttcatcactaagagttaagaagattacattttagcagaggaaaaatccatacaggtcgtcccttcaaattttataattgggaactattagctcatttaagtgattttgccattgtttgaaacttctgaaattcctcttctaagatttgttttggaaactgtgtattttaaacatgtcttccaatgtggcatatctttaccctttgaaggagtatttcatttttgaaaatacttaggagctactccaaaaaaactgttatgataatagatatttgagaatagcagatatttgagaattttttaaaaaatgtgagaatatatagtaatgttacttgttgtcttgaacattttgtaaactgagtgataattcccaaagtgacatgcaaaactatatcatcaaaaattgcttcatcagaatgacttatattttcccaaaatgactgctttgaaggacaacattcatttgactacatttctcctcatcacctaccctgatcatcctatttaaaatatctagtttgatcactctatttaaaatagctatttctaatcaagatctctgttcagtgcataattctcccatgtcatttttaataattgctatttataaagaacagaactgtcttaatattgtatatttcagttttctcataataacaatggctatgactcagagcaaaaagtataattttcccagtagggacctgtgggaataaatatatatatatatatattttattacgaacctaaggaaaatctactgcattgtatttacctacaaaaatgaaaacaaaaacacaacaacaaaaaccttctaaaaatagctagtgattacaagaaataacactctgcagaccttcttctgtgtaacgcaaggtgtttgcttattgtgcttcctttatccagatctgaacactgtgatccagtttctgttgaggtgacataatttctttcctaacaaaagagtcataaatttaggagcaacttacataaagtttgagatgagttagattgccctaaaaactgaagaatactcaatttgcttcatgctgtacatgagattatgtgtaaatgtgtgtgtgtaaaaataaatactatacacacttatttttaactcaagtattacaaggtaaaatgtaaaatactggtgtgtgcaccagttggggtcctctgaaggagaagatgctgagagacaattagcagtccaagaagtttattggaggtaatgcccatgaaagacaaagggaggaggaagccaattttacacctgaaaaggaaaccggaggaaggggagcgagatggggcaggaagagcctcagtctgcgatgcagatgcgagtcagtatccgacaaaccaacagggggctccagatcaaagaggcctgctgggagtctgacagttggcagaaatgactaggtcctggtacctgcagcacactcagtcattggctggggggtgtgggggaagagcgtggcctctgctggaaagccgaggtagacactgaaggcaataacagctgggagctgtcagtaactgcatttcttgaagctgaaaaagaagttttttcttgaagacagatatgagtagcacatctccatggctgccacagtgtgtgtgtttgtattttgacactactatggtcaaagcacagttgaaacaaagttctctatcattgaaagtctaccttcttgtgaggtattctgacattacaacacatattaacagattacataagcttgcctgattttccttggaaaaactatatgtagttggcttgatttgggtacatttaaagagattgacgttactaaaatattccatactcctgaccaatggcaacaatcttaccattagaattaggtaagcctggacaaccaggacaggtgggaatgggaaccctggaatcaaatccgcaacacagagcaagcacaattataactaccacattcattttcctcttcgtatttggggtagaggacatgaagaagggaaaatgagatggagtttgcagaggaattctagaaaagtttatctttgttcagaagtaggaaaataaaaataaaacctgtgaaagaagaactggattaagatctcctttatttccctggtcattgacttacccacaaaggtatgtctaatatataaatggaatcagatattaaccctggaaaacacattggtagcatatattactaaatcttattttattagtatttttatgttaattttcataatattttatgaaaagtttagtatgttaagactctgtggtaccaagaatagaataaaggatgggttagaataatagagaggctaatagggagttttgtaggtcagaaaattcttttagcttctttttaaacacctctgctgatttttccctatggaaagaaaagtgaaaaacataggtaacacattgtgatacaaaacacagaaatatattggatttacagattctttctttccttcataaaatttagcatttgtaccttttagttctcatcaaaagtctgttgatataattttatgcatcagttttgaaacgtatagctagtatacaggtaaataaatatttcacgtggtttatgaacctacaatgtttagaacatcttctcaattaatgatcagatatttatttggcacctacaatatgactcaaaatttggaattgcattgtgtgtcatacacaggaaaagtaagtctttaacaactatgaatctctaacctatttgaagaggtgagaaaaatgcacaaaatacaaagatacaaagagggactgatacaaggcaatatatacttaagggcttaaataatagtggctttgagatgggtgagttgattgggctggttctagaaaatttgtggagaaaattggatttaagctggacaatgaaaatgagtaggttttgaatagacaaagaagcaatagcagaaatcatgtaagcaaaatcagagacatcagtgggcattagtgtggtatatagacattaagagaatgattggatttggttggatgacttacgctgagagaggagagggaaatatagttgaccctagagtcctgattatggaggtcttgggctagacagggcataagaggcaataaacaattgttgtaataataaaatgtaattagtgtaggttttactattgttagctcaagcataattgtttagcatttcttttctattctaccccttttctgaggactcaaccttttgttttggaaagcttatgaaagttatagactgttgaaaaatgttagtctacatagagtttggatgaagcgcagcaaattcctagctgtgggaagatgtttccaccaacagttctgtgggagacagacagacttttgctgctagaaggctcccaccaggcagctacaaaggcacagctagcagggctacttatcacagggatggatggacagtcggcttgcctggctccctcctgcctaaccctattgctgatctgacaatgctcagcaggctctagatgtgactcccctcccctccctggagtccccacgtcttgtctttggcatctcattcaagctccacagatatcctacaaattcctattccattgaattctcctttctcctgagtccagttgattctcacatattcttgcctgagtaggagagtcggggtttccctctagtctttttttttttttttgagacggggtctggctctgtgccccaggccagagtgcaacggcgcgatcttggctcactgcaagctccgcctcccgggttcacgccattctcctgcctcagcctcccgagtagctgggactacaggcgcccgccaccacgcccggctcattttttgtatttttagtagagatagggtttcaccatgttagccaggatggtctcgatttcctgacctcgtgatccacccacctcagcctcccaaagtgctgggattacaggcgtgagccaccgtgcctgtccccctctagtcttttaaaaatctgtttttatgacattggactctgtgctctcattctttcaagatcttactttctgattctcaggagtcttttctttcctcaataatcttggttcctgcacattgaaaacattgtttttgttttttacatgggttcaagaatctgttttataattataattttatttttaatttttgtagagatggagtctgtgttgccagggctggcctaaaactcctgggcacaagggatcctcctgccttggcctcccaaagtgctgggataacagacgtgagacactgtgcctgggcaagagtctatttttgtttcttgtttttttgagacggagtctcactctgtcgcccaggctggagtgcagtggcgctatctgggctcactgcaagctccgcctcctgggttcacgccattctcctgcctcagcctcctgagtagctgggactacaggcgcccaccaccacgcccggctaagtttttgtatttttagtagagacggggtttcaccgtgttagccaggatggtctcgatctcctaacctcttgatccgcccgcctcggcctcccaaagtgctgggattacaggcgtgagccaccgcgcccggccaggagtctattttaagtcaaataaatagcaacgagaacaataattgatcactagcagtttcttttaatttttattcctgcttcataattctgatttcatgaaggcaaagtagatacctctgactgactagggaatcacatataaggaataagaaaaagagcaagctattgttatccgtacataataataatagcttatatttattgactacttagtctgtgtcagaacctggggcaatactcatagattatttcatgtaatcagcagtacagttttaagggttgtgcaccactgctatctgcattttataggtgaagacagcagaactcagaggttaaatatcttgccatccttgcagtactagtaagtcaacggtgaaactaagattcaaacccaggaaatctaccccaaagcctgcactcttactggctgtattcttaaatattttctttatcaagggattaacataattatagaagtatttttggaagattagtctggcatctgcatgagagcctagagagaggattattagtttggaggttattttggtctttcaaaatgccaggagcttcaggcataaactaaagtggaggccctaggtgttcagcctagtgaaccagggtagtgtgagcaacatgaagaggtagagaaattaaaaattagcaatttgagaaattaatagaaaaatagacagtatactcgagaagtatttttcaaacttttttcataataaaatcacctggcacacttgctaaaaatatcctggtcccaacccaaccagcctgtcaggagattttctaagtgaatctctatcttaaataagggtcctaggtgattcttgggatcgggtaaattacagaagtcatcctagaatgtatcttttaatttttcctctaccgaaactatacattgcttaattacagtggcttttcttaactcacagacacaattttcctttttacaattagtagctgatgtgtagagtggttagcacattaggccatgactgttaaaagcttttagtctaactagtaaatcatccaggtaatttgaggttttattgccattgcattgttgtttatggcagcaaatcagttgatttgctgctaccagacacagggtgtaaagtcatatgccataattaaatgatatgtgacttctaaaccagacatcttttgaagatcccattttatcagccaagtcagccaattttaaagcagagtgggttaatcactgagaccatttcctcagctgcttctatggaaagtcaaccaaaatttcttatagttggtgggttcaagcttcataagttcagctttagaattcaattgtaaagctgagctcagattttaaacaatacatattttgggctgaaaattctcttcagtgtttataatagtctggggaaatgaaggtaataaccattttgacagtaaatggtaacatatgcaatttttttacatactgattccttcatcaattttgtatctaattactaagcacttgggaatagaggcttctaattcagaaattgtcaagtgaagtattaggcatactcaaggcagctcaccaaaggtgagaagtcctcttttttcacatatttataaacaaggaagttattgttctttgtttacttcccagatattcttagtaatatttaaagaatctcagagaggcttgcaaggatgttcaaagtccaaagtccttgccctaaaacagcacccagtgctcctcaggagtccagtattatctctaattcagctctatcccaagcgaccaatgtccaatttcacgagccttttggttgtggagttctctggctttagcagcatttcatctatcattgagaatgagatgagaatatctcaacgatggcagataggattctccctacttttcaggtctcttgtaaaacaacataaagaagccagaggagagaagaaatccagaattgtagcatagtttgcattttagttcttgaatcagggctgggttttcttcttcttgagttaaattatgtaccgatctatttatcctagaggacaaatagatagggaaaatggacccggggtgatgtcagagacaatcctgaaagttttagaatccattagtttgccaaggccctgaccagttgtcggtaatagacagtagactttcataccactgatccaattccaatcattaggggacacccagggatctgtttttgctctaaatatcccaattgaactgtattttccttatttatttaatcatttatatgtatgaacatggacacatggataaaatattttatactttgcaacataatattttatattacattattttactgctataattggtttagctttagccactggatgttctttcagaatagcttctttgtctttttcacatgtcccttcctttactttctggtaccccaagatgctctagactcatcttgtatattttcttaaaaaatgggaagtcatcagcatgtagaggtttgttgaggctatcatattatgatagtgtgtggatgtgtaaattataaaaagaagtgtgctgagaatgaaatctaatgccaagatttcattttcagcaccctctttttataattcttttaaaaaatggttacaagaaagatattcttagagcagatggaaaaaaaaactagcaggaaaacagaaataatcagaaggggatagaaacaaatgtaggatacttccaagaaacaggagatagaactaatatgaattagttatttattgattgcttcaagaaggcttcatgaaattctgggaaatacatgagtcagtgataaatagataagtttattgtaggtcaggaattgtgggctctcaaaactctgtggttcccctcagagggctgtaaaagttaaagcaatttgattggttttatattcaaggagaaatattaaagagttaactagttaaaaattaagacagaaaaacagaagataatttattttctacaaaataaacaattgtagaaatcaattctttgtataatcaaaggatagcatgtctgaaggaaatggactgggaagaagaatgtgtttgacagggtatagaagtggggatgtggagtcctgatagctggaccatgaagcatagaacctgaatctatgacttaccttctcttgggatttctcattgattactcactaattctatcactttactaactacaaggaggtctgtttctactttaaaatatgttcaaatgtaggtaaatgtcacttggaatatcccagaacacaaccatactgaggaatacagaggatactagagctcttagtaatttggctttgaagatgctgctacctttagcttcaagttcataagttcctgatttcccagtctctctccctaggattgatgccaattttattttatttttttatttttatttttttttcgagacagaatctcgctctttcgcccaggctggagtgcagtggcgtgatctcggctcactgcaagctccgcctcccgggttcacgccattctcctgcctcagccactcgagtcgctgggactacaggctcccgccaccgcgcccggctaatttttgtattttttagtagagacagggtttcaccgtgttagccaggatggtctcgatctcctgacttcgtgatccacccgcctcggcctccgaaagtgctgggattacaggcgtgagccactgcgcccggccgccaattttaatactcactgcccaagacaattcccatatccctgtgtcccaagtgtctagaataatgcctgaactatattaagcaatcaagaactatttgttgaatgaataaatgtatgaatgaattaattatatcctaagttacatttcaatattttagaaagatgccatcttatagcatcagcatacttgtctttgtttaccatattatagctcttggggttttagatgttaggtctattttcctaaatttcaccctctctccttttttcctccctagttaattgtatgtctctcctgttattgatattgccctacatttccttgtaaaatattttacaaaattgttcaggcttcctgcataattctgacttgaaatattgtgcttaaaatttttctatattgcttctcagtatcttttctaaaatagatctatgtgataattatttttggagggggtatgcttttcaccataacaaggaatatgaaaatttaaatgtgttataattttttacctccacagattgttttgcttattggtgtttaattaaaaaccaaacaacttttcctattaacttgatgctacttattaattgaaatgaggagactgactctggatattgggaaaatttatggtaagtctttactatcttttcccatggtttgtggattatttactagggaacgtttgttacagacttgggcttcacatggttttccttgagtctcacaagtagcttccttttgaatagatttagattccctaaacatttggtaaatgtctagcacatgccgaacatgtaggtagatgttaggagcttgttttaatcaatgaggaaacagatgtacagtgactcagtgactgtaatccagcaactatccaataactatggtcccacagtcagtgagagaggtagggttaaagtctatctcttgggactcaagtccagtactttttcccattatatacttggtaaaagctcatatatatatatatatatgagcatttttacttggtaaaagctcatgtgtatatatatataatatatatattatatatatataatatatataatatatatattatatatatataatatctattatatatatataatatatattatatatatataatagatatatgagtatatatatatgagtatatatatgagtatatatatgagaatatatatgagtatatatgagaatatatatatatatatgagaatgttcactttcttctggggtcctcatagcttaaacgataattcatggtttttattttgtgttccttttctcttagtctggaatagcaaattgacctcaaaagatatattttgatcaggatgaattccaaagctgaaattagttgttctctgagttcagagttttagattaaacatctctctcttgatatatatatctatggtaagttatttaaaattattcttaatatttggaataagagttaaacttaagaaaagtaagtccagtagtatttgaagtaagctttaaattggactttggttatttaaaaatgttttaatcattaaactatggaccgaaataaagtattcatgatggacataatattagactatcaaaagtcaggaaacatggccttgatgacaaacttaagagaagcagcggagggtttgctgctactgaagattttacatttaaaaaaaaaagaaaatagactgtgtagtatttgaatgaattcctaaatataagaagctatagtttttgtaaatatttgaattccagaaaataaaattccacagctatgtatgagaaagcacattttaaaaaaataagatgtttttggccagtcgtagtggctcatgcctgtaattccagcattttgtgaggctgaggtaggaggatggcttgagcccaggagatcaagactagcctgggcaacatagtgggacccccatctctacaaaagataaaaaaattagtcagtgtgatggcacgtgcccgtagtcccagctacctaggaggctgaggtgggaggattgcttgagccagggagggagatcagagcctgagagcttgaggctgcagtgagccatcatcaccctgctgcactccagcatggatgacagagtgagaacctgtctcaaaaaaacaaaaaacaaaaacccaaaacaaccaaatgtatttgctaacttgctataaatataaaatgatacttcttttttagattgtaaaaaatcaagtgaaactaactttgtgctctttgatcatcatttccgttttctctgttcttcccacctgcctccccagaccctagtaatcaccattccactctctacttctatgagtttgactaagattccacatgtaagtgacatcatatggttatatatatacatatatatatatatataaaaatatatataacgttttctttttccattcatccattgacactcaggtttattccgtatcttgaccctcgtaaataaagctgcaatgaccatgggagtgcagatatctcttcaacatactgatttcagttcctttagatatataccaagaagtgggattgctggatcatattagatgatccactgcacagcatgcaatagtaatctgcacagcatggtcactacatagttaataataacgtattatgtatttcaaattattaaaagagtaaattttaaatgttctcaccataaaaaataagtatgtgttgaatatgggatatgttaattaccgtgatttaatcattccacactgtgtacatgtatcaaaacatcacattgtaccccataaatatatatataattattttgtcagttaaaaataaaatacaagtaaaatcactttaaaataaaaaaatcaattgaaagcatttctaagcatttgaacatgtaattgttgagaaaacacacaatgatttcgctaattccagctgatcatttttccgctgagagataatatattaagggagtttagaaatacattttcagaattctatctatctacctatctctatctgtctgtatatccatccatcacattttgaaatcttttttaaagtaaaaaatgtaataaaatgtctcttgtgtagcaaatcagcaaattaaattgatataaaattctctcacatatgcttgacttaatgtaataataaatatcataacatatagcttaaaacttatctttcatccctttccctttcctctttctccacaggtgaccattattctgagtgttttaaaagcaatatttttctattgaagaaatgaaaatagcagtcattcaaaatcctattgtgctatcttttgatcatcataataagcaaacgcaaataattctcccttggtgatccaattaaatgattttaaaatatcagtgtcaaagctgttccttctaaaatttaaggcaaatctaatagattctaaacatagattacaaactcaaacgccctcaggtgccaggcaggagagattagagagccgcctgtcagaatggagacgctagatttagtttatccccaatttgtaaaagacagacgctggttgtcttttcagaatgacaagaaatcaatagacaatattatcaagtggtcagaatcttgaaagaaggcagaaatttaggtatatttatttctaatttctaaatgttgacaaagatttaaaattttaaaagtaccttgtattttaaattaaccctgttggaagtccagcgtcagctgttggactgctactttgcaattacggcaaagtgggacagctacaaccatctttctggttgagtgcactatcctctttccctttccgaattcacttatttattaaactacatttgctgctcaagtctgggcttcctggatgtaaaaagttctccgtgatctggcatcactctgccatcctgccttcaaccctgctgctcccatcagagtggcttccttgcagtcatctgacatattcaacattgttttgccttcactgctgagctcatgaagttggtctatgaatgtgtcatatagtagaaagaaactggatttggacaaaattctatgctgataaaaaggatgatgaggccaatgctgtggatgtatttatatatctgctgaatctgtcatttaggaattagtaaatagttgctgaatcctttgttttaaatatcgcgtacttgaaaacgataaataatttttcaacctttggttcttcagattgaaaaatttcagctcacagaatctttcccaagatagagaatttctaaacctgtaattatttttgtaacttgcctgtaaactctctttacattttttattctttttgtttcaagtctacaatatttctcgttgtttagaatgaagttgataatattttaatataaagcagagtttctgcattcattagtatgttctgattcgttgtttatagtgattgttttaaccatctctgaatctgagtttttgatttgcaatgattttgtgaattattgtgacatgttggcagctgtattaaaccatcgtattgaagagatattaagtaattattagtccatattcccattttaaagcgttaaaataatataaatggcatacattcttcttaatatcctggaatactgaaatgctttcaaccaaacatataagaattttagaaagctagactctgacatgagcaataaaacgcactaggttactcagaatagagattcacttagtttaaaagtagtttttattgctacataatattgtgaagcaaactattcatcagtagcctcaagcatgtactacctgcatgaaatacagggacatctgaaagactggaggaataggttggatttcttagcctcttttgtggtttccttatacttttttctgatcttcccattaataatccataacacctagcactggctatcaaatatactgaaaaagcttgttgaataaatgaatcagtgaagaaatttgtgatatcctttcaacaaattctttatttctctctcctatctgtcaattcccattgtatacataatgaatatctacacatgttactaatgaatggaatgctatgttcttcctttaaatgaacacatgctccaattccttagtctattaagatgcttgatagaatgtggcttctctgatctgaatttttgtggaaagatgtattagctagatatccaaaacatgacatgttttgaagaatgtgctcaaagtgaagaaatgtttcaaattcccaaagcacaacttgaagtattgttgtaattgtgacttgttggcagaggaaggcaggaggaacagtagtttggcacccagaaaatagaaatgcagtggaccattttcagctggaaagtcaagggaaggttggaaatcaaagtgatcaagtgggtgaacttagagcaaaattttaggagcataaggctgagaagcaaaacatctgattttgtatctcttttatcacttgctatgggaaaacttcagttttacatttttaatcaatgtggtagtactaatagtacctactacctaatagtacctaatggtatgctttttgtgaggattaaagaggcacattataaagtaaataatacagtacctggtacatactaaggataataatactgtttttattgttatagaagctataaatcagagaattgtcacattctaagatgtgtaagtcctttctggggaactgacacacacagagcaaaatcattagaagcatctttgtatataatgctgtcaaatgaatatgtttttgattatagctttcaagataacatagctattaagccttagataaattattatttacgtttttttctccctttacctactccctgcctcattttctccattcttacttccttctttcttttccttccttccttccttccctccctcccttccctccttcccccttctcctcttcccctcttccttccttcctttcttccttccttccttcattcctcccttccttccttcccaccagtatttaccacctcacaactatattctagagtatcctgggcactgggaatactataaatatatttattaacatatctctttctatagctgtatatctaagtatttatgtagttatctgtattatttaactacctagctatgtatctatctacttttctccagcttgggctgtataacaaaatatcatcgactaggtggcttaaagaacaacaacaacaaaaatttcacccagttctagaggctggaaatctaatatcagggtcccagcatggtcaggctttttttgagggccctcttcctggcttgaagttggctaccttcttgcactgtattctcacatgacggagagagtaagctctgatgtctcttccgcatcttataagaacactaatcccattattggggccctaccctcatgacctcatctacacctaattacctcctaaagaccccacttcctaatatactgggagttagggcttcaacatttcaacatgtgaatttcaggggaacacaactcagttcgcaatactatgtcaatatatttatgaaaagggggtggctaattctaattgagtcattgaaattctcataaaagaaaaatgtttaaactcagccttgagtatgttctccaggtggttagatagaacggggagtagagaaagagaaaaagggtagaagatgtggaattacaaaagggacagagatgggaactaacacagtggtatttattggcatggttagaagaaaatagcttcactaaagaatctggacattgccgtgatgatcactgtgtcttcagtgactgagtgacatgatcagggtcaccttctggcagcagcatggagaatggattagagatggcatgaagattttaggagactactctgatagttctaacgaaatacactgtgggcagaagtagtttggatgaagaagagagtaaataaaaaatgacaagattttatctcccataaacctacaagaattatatacagtcatatactgcatataatatatacataatgtataaagatgctttggtcaaagacagactgcatgtgtgacagtggtaccgtaatattatagtggagctgaaaaattcctgttgcctgatgacgttgtagccatggtaacgtcctaacacaaagcattactcatgtgtttgtgatgatgctggtgtaaacaagcctactgcactgccagttgtatgaaagtatagcatatacaattatgtacagtacataatatgtgataataataaaaaacaagtatgttaatggtttatgtatttactaaactataatttttaattgttgctttataatgcacttactcctacttatttttaaaaaagctaactttaaaacaaactcaggcaggccaggagtggtggctcatgcctgtcatcccagcactttgggaagctgaggcaagtggatcacctgaggtcaagagttcaagaccagcctggccaacatggtgaaaccccatctctaaaaaaaaataaataaataaaaacacacacacacaaagcagtctcagggatgtacttcaagagatatccagaaaaagacattgttatcatataagagaacaatgttattgcccctgaagaccatacagtgggacaagatatggagatggaagacagtgatattgatgattccggccttgagtaggcctagtcttgtgtgtgtgtgtgtgtgtgtgtgtgtgtgtgtgtatgcgtgcgtgtgtgttttgagacaaggttttgtactgtcgcccaggctggagtgcagtggcatgatctaggctcactgcaacctccctctcctgggctcaggcaatcctcccatctaagcctcctatgtacctggggctgcaggcacacacaccaccactcctggctaattttttttttttttttgagttggggtttcgccatgttgcccaggctggtcttcaactcctgggctcaagtgatctgcccacctcaacctcccaaagttctgggattacaggcatgaaccaccatgcctgcctggcctaatgtctgtgcttatgtctagttttcaacaagaaagtttaaaaattaaaaaaataaatacataaataaaatatagaatagaataagagtgcaaagaaagaataactttgtacagctatacaacgtgtttgcgttctaagtgttattacaaaagagtcaaaaagttaaaaaaattaaaatgtttataaagtacaaaagttattgcaagctaaggttattttattatggaagaaataatttttttaaaaaatgaattcggtgtagcttgcatgtacagcgtttataaagtctgtagtagtgttaccaagcaaaaggggcttgctgcctgatgcactagaggccaatagtatgacaccgagttttttagaaaagaaaagctttttattgcaggttgactaacagaggagacaggagtccagttcaaatgtgtctccctgtgctgactttaagatagtacttttattagaaaaggtttaagggatgaattctgggattggtagattggtggaaagaaagaggaggtctgaaaagtcctcaggaatgcagttatctttcatgctacgtcatgggtcacaagtgcaaattcagggggagttaggatttaacatgtggtggaaactcaggctataatgttagcaagtttgttctgcacacactgctgtcagccatattggttcccatccatttcagctagttttgttatcttacaagtgaagggagtttcagcagttcagcaagttgtttcttttcttatctgccatctttcaaacttgaaaatttctgttagctatttaactccttgggacacggtttcagtagtagacgataatgtcctaggtcttcacattccctgatcacttactcaccacagagcaatttccagtcctgcaagctgcattcatggttaagtgccctgtacaggtgtatccttttttgtctttgatattttcttactgtgccttttctatgtttagatatgttgagatacacaaatatttaccattgtgttaacaattacctgcagtactcagtatggtaatatgctgtataggattgtagcctaggatcaatagggtataccatatagcctagctgtcttgtaggttataccatctaagcttgtgtaagtatattccacgattgcacaacaacaaaataacctaatgacacttttctcaggatacatccccaatgtcaagtggcacatgattctgtggtttttcaggctgtgtttgccagtgggatgccaagagatgatttctgggggcatatgcttacctctttttggcttggaggttattcatgatctctgccttgcctcctccaaatggtgctgagtacctcctttccacactgttgttccaataagtgtcaccagtgctgctgggatctcatttctgactttagctgctcttgctccttccttggtttcatttttgtagctatttctgctggttctagtccaacaccatggtcacggtcactgcttttgctggttccactaccatcatgatcatgggcagacccaggatttttcaggattgctatctctatcatgtttgaaggctcctgccagtctgcagctgctattgtagcatgctttgctcttgttttactatgagcatgaagtgtagcttgtgatggtatggctttcaagcattaaagttaagatttcattcttaactctgccacttactaattttgtgacattttggttaagttactcaaattctttgagtcttagtttgtttatctttaacattaggataatgctacctaccatgaagtgttgttctatggattcaatgacttcgtgtaattaaaacacctcacatactggttccacaccatgcagcctaaagtaactacttattattgtcaccttaagccccatcatgagcccacctgagtcccattgccactttcgctctcttgtacttcccaaagcttattgccatcttgcttctcaaaaactcttatggataacaggttaaaaagatcatttacataactacaagtagaatatatggaacataacagttgcttgatacatgctaacttctttcccatccctgttcttgcaaactcccattgggttatttttccttagggacattttccacagtttcctttctttggtgctataatccatctatgtgcattattttgtggaagcctaaatcttagtgtacaaatttacctgaccatctaactcaaatgaccaaatagcccaggagagagagggacacaggccagaagaagcagaattggagaaattaaatgggttatatctgctgaaacttgaagcaattaaaaaaatgtccattatactatccaaagagagtaacacactcaactatggtctggacatttgtttcaagcaataaagttaatatgctgattctagccataagaaaagtgcagtaatggctgatgctttaaataaagcattaaagttttgaagcaatattatactcacagtaaaactctaacttgcgacagccagcaaaggagcttcatagggcatattcctccccatctcaggtgaacgacacttgttgagaggatatatggcttctgacacccaaataggcaagagttcagagaaaagttccatttctaatgaagcatagagtaatggttagaagtatagtcccccagaccacattctcttccagctatactgcttagtaactctgtgactttgggcaacttatttaacctcttggtgccccatgtccccatctgtaagatgggggatgataatgacaactacttcataggttgttgtgataatttaataggtaaagaaatgtaaagttctacaaaaaatgcctggcatatagttgacattgaacaaatattagctatgttattattattactttcattcgatagggaaatcaagacaaaacagagttccaagggtggacctgatagattcatagggtggaggaagaagaaatttcagggaaaatttgcagcctgaaaacaactagtgaggacttctgtctggcacaatgacatcaggttgtgactgcacttctattcctgagtcaagactggctgaggaatagggtggatctgatccagcagacaaatcctcagtgatgcccgctggagaggctggaggaggcaggagtttaaacagtgcagaattcttgctgccatcctgctggcctcccaggggaccaagagagcacttttgtacctccatcctactgtgactccgcagtgcatccaatctcatgcaaactcctttagctgtacttgaagctgttctggatgattaatctgcttgtattgattatttttagcctaagtttaaatgaagagcaaatatttctctctgatagatttacagtgctttgtttattgggaatatttttggactgaacaacaagtaaactatgctctacataaaatggtaatggtcaatatgctaaattaggtaatactaagtaaacttttttagtatagtctcaatacagagataataggtaagttcaaaaattttaaattactatgagtacatttgagattctggtgcttctgaactacaagtgatgatgtcattgaggcacagaattactttctcaggtggtttgactattaaaaaagtgtttacattagattataagctggcaaatatcagacacattgttagaatgtttaatattttcatacgtcacaggagaacctggaactgtgatatcaagcattgcaccttttggatttaattctgtagttcttcctaacatttacttgctaacctttggtgtttatttcctttttgaggaggggagttgttttgctctgctctgggtaaaacttctaaaattattttattttgtacaaaatttatgtttgtctttgaagtacagaatttctacattggtttccctatttgacatgtgaattagatcactgggattttcaatcctgaattgtgtgaagaatcatatctgaaataaatttagtggattaagctagttgataagatccaatgttgtgatttatatttctatatacatgttactatatttccaattatcttttgaatatttaaaaagggtgcctgatagactataagaaaaattttagtgttttttggaaaataattttatatttttgcactgtgtgcccactttttaacacaaatgcatgttttttcagagaaatttaaaaaataaagttgaatattttgggctgcggattttaacttccctaggaagtgccgccctcaaggcatctctaccattttgaaattacgactataatattgactataattatgactaaaatatttaaacaataataaatattttcaaatatatatgttggccatttaaaaaagtattgcattacatattttaaaatttttctcacttttaaaattcataatattattttacatttgtatattactctatttagaggcacaatgcctagcatagaatttgaactccaccactgatgtgatccatcttgggaatattacttaacctctcctgaacctcagtttcatattgtatggttaagataaaaatagtacctgcctcacaattttattgtgaggattatatgatttaatataggtaaggtgattaaaacagtatttggaacccagtaagggatacagaattatttactttgttatttttaaaacttatttggggaatataggaaaaagtgatataaatcataaacctgcagaggggattttctacacagtattattacaataatctccccttgaaaaaggatactaagagtctcactgtctatgcttagatttaacatgaatacaatatgaatcagagaaaactttttattgatcagcataagatggttagaagaatgctctaatatccaagtaataaccatgatgttgaactctgttctttaaataagacaaagtagttgaaacagttgtaattatctgatactctcacctgtaggtgtaggtaaagtaaaccagtgagagctaagctcccactctgctgcagcagagggagatgaacagactagtaggaaagggactgctcatggaggacatgggttgtggtgttagagagcaatataaaaagctgggctgtggtcagggctggaactgctgaagtacacagtgcaattgtgctttgagacctaacttgcccttgatcacatctatgagaaataggcccagaaagagtcacttatggtccaaaggtagcattagcattctaaacacatctagtcatttccattccaaggaagaatgcccagatagatagttgtgaacatctcttatcttgggatcaataatggaagaatagaggagcgatttgcttcacttctcttttttctttttaaaatgcactgtaaccaatgtgtctggcttgaaggctattaactgggttgcatcatactggtgggctagggagttaaacaatacagactagaagtcattgctacaggttttttttttttataaagcatatgctaatgtgatacacatttatctcaaacatgtatcccaaaacctactcattattttatctcccaagattatttcctttgttcttgattaatattatcactatacgcctgcttttcaaggtcataaatctctgtattccattcaatttcactcctttctaactcttcacataaaatttgttaatttagaccagtacgtgtcagacactattctgggaactagttgtattttagtgaaaagaaatcgacaataaaaacattacctgtcctcatggtgttgacaggagacaagctcacaaataaatatatgatttagtggagtgttatgatttgttatgttttgtcattatttttatatgcttttatataaaatatgttatatcatttatataataaataattgtttagaagtatcagtaaaatatcttgaataggaatgaaacgataatttaaaatgagtggtatcagcagaaaacattatagtggacccagaaggaccaaaaaaacaaaaatataattttgttattcacagaaaataccttgagcctaggaatatttaattaagcaaacatttttcagacatgcgctatgtatatttttattaactccacaaaaatttcttgagaatcttttgggcactgggacaaaatagtaaacaccctatataaaatccctacccttatggaatttacattctagtggagaagacagatgaataagaaaatgccacacacatacttcttaactattctacttcctagctttcccagtctgccccccattcaataaaacctttcttaccagtgccctgttgtggccctttccaaccacagattattgtatcaattggtctccacttcatcatctatattgtcatagttatccttctaaagcatagagttcatcattagagccctctgatattaaccttttatgacttcctgtcatcttccttatgatttcatttacattccagtcctgtgattctccaatcctatttactgctttataacctgagcaacatatcctcttagctgcaacttcagcttttagcttaagaattgctcatacttcattgagaaaatataagcaaccacataggagtgttttcatcttcttacctccgtattgtaaccctatttccataaaataatatgtatcatattcttttttcttcctttgcagcctgtcgatggcaaatatttccacttgtgcttccctttagtttcaagacctttgcacttgaagtaattgtatcataagtttcttcttttctagcgtgttattcccacctgtatacaatatgctaattcatttaaaacatctattccttgattttccatttccctaaagatattactccattttttgtaatattgttatcttaacttgctctctccattcttcacctactgcttactaatcaacctactccaatctggcttccatttctgccattcatggaaacctcagcccatcttctctcttttcttttcttctctcctgcctcatttcctttctttattttgccaaggacatcaataataaccacattgccaaatctaataaacctttctgtactcatgttaccctgctactcaggagcattcaatatgagtcagcctgcattccttgaaaaacttgactgtctagactacttcttcctttccagtctccttgttctggatgatccttcccctttacctgaaatcataattatccacaccctctccctaggtgattgcacttagtcactgtgatttaaatgctaacaattgaaaaacgaaagagctccagacgtatacacctactgcttattgtacttgtccagttgaatgcctactaggcatttcaagcttgaattttacaaaccagaacttctgttttttttccactccccacctgttcttcgaaaagtcttccccatcccaataagtggtaccaccaaacacccaattatgcaaaccccaatacctagaagttatccatgatttctttattttttcctcatccccccacagcatccattagcatgttcaaaatatattttgaatctctctgcttctttccatttatactgttactaccttgttttaagtcacattcatcttttctggacaattgtggcagcttcttaactgctatctttgcttcctctcttattcatgcccacatagcagccagagtaatctttattaaaatatgcatcagatcctgtcacccccttacttaaaactcttcaatcgttttccattttgttgaaaataaagtccagaaacttttctgccaaggccctgcaggatttagttcctggatttctctctgggattattccttactgttctgctctagctgatttcattctagccacaccatcctcctttctgttccttgaataagccaaactcttttccatttcagaacctttcatttgatactcctaacacttggaatcctctttctccggctttttgcatagcagcttatttttctttgactcttagctcaaatgtcatttccttagagaaggcttctttactttttactctaaatagcatattggtcttgtgagaatatctacaacaaacattttctagggtcaaatacagtttgacggttttatatatattacattgcctttttggaattcttatgcacagtagcacattatagcttcattaattcatacattcattcttttagttaacatttatgaacacctgctatgtgccccaaattattctaggtgcttgagatacatcaaatagtaaaacagacacaattcctaatttgtaaagtttacattctagtgagtgagacaaataataaacacttaacataattcaaaacaaattatatagtataaggaaggtcattcatgctgcagaaaaagagagttaggtaagtaggattgagagtgccatggtggttgcggtattctgagaatcatattatgaagaaaccagcatttttcaaaattattaaaccatgcaacacacattataatgttgtgaaactaattttccaaggaacacactttaggaaattatgataagcctacctttcattctcttctctcctacattcattttacagagtagaagcctgagttctagagaagccatctaattatccatgagtcacaaatccttcctagaaatttaagatatgatgtacgctttacaaagtcgattgtgaggattatgatagaaataatcagttgcatatctaggatatttggcacttgaagtaacttgtttatatgacaaaatttcttccagtaatagtcatgaaataggacaaataaaataatggttagaaaaatcagcagactttaaaatttttcttctattgaattttgtatatgtaataatgccaataaaaagaatagtaagtaaataaatattacagtacaaaatgagaaaggtaatgggttaatacttttaagttacaataatattctctttttaaaaacatgcccaaataggtggtctgttacatataacaattattagggactgaatgtgtccctacctgacttccagccctaaatttgtacgctgaaactctaactcccatgtcactatatttagagtaaggaagtaaataaggtcaaatgagggcataaggatggcgttctgatctaatagaatttgtgtctttataagaagagacatcttttttttctgtctttccccgagggcacatacagaggaaaagacatgtggggacataatgagaggacagccatctgcaagccaagaagagaatcctcaccagaaaccaacttgactggaatcttgatcttgaacttcttgcttccagaattatgagaaaataaattgttgtttaacccacacagtctattgtacttagttgtagcagtctgagaagactaatacattgataaactggtcagttacaacaatgaatatattatttatacattatataaatgattatagtttctgtattagcttagattttgcaaatttgtcaatagctttgtccaagttgattttctttatatattcctatttcatagactatattagctagatttgtcaatctatcttactcataatgactgaagaacacttttaaattcaatttaaaaggtttttgtcacataaagcaacaaatataaaactagaaaaaatataaatatgaatataaatttgaaggaaattaataaaaatcgtattgtaccatatattccagaaattttaaacactgatgaaaacttcaagtggtaccaaggaatgagagaattgaagtaattcaagtgttatatttcatcttttctatcactaggttgtcatcaattatttcaaatctgtttttttttttattgtaattaaacttctaagttcagggacacatgtgaaggtttgttatatgggtagacttgtgtcatagggttttgttgtacagattacttcatgaatccgttattaagtgcagtacccattagttattttttctgatcctctccttccttgcaccctccaccctctgataagaccaactgtctgttgttccctctatgtgtccatatgtactcatcattcagcacccacttgtgagaacatacaatatttgtttttctgttcctgaattagtttgctaaggataatggcctccagctgcatgatgctcctgcaaggggcatgatcttattctttcttgtggctgcatagtattccacggtgtatatgtaccacattttctttattcaatctgtcattgatgggaatttaggttgattccatgtctttgctattgagaatagtgctgcaatgaacatatgcatgcatgtgtctttatgacagaatgatttatattcctttaggtatatccccagtattgggattctggggtctaatgatatttccatttttaggtctttgaggaattgccacactgttttccacagtgattgaactaatttacaaccttcaaaacagtgcataggcattcctttttctctgctaccttgctagcacttatttatttatttttgactttttaataatagctattctgactggtgtgagaatcttctgcttaactcaggaatgtgtagctccacgagagtagctccccagcacccaaagagagcttgaaggattcaaaaccgttatgaacttcctcttaaaatgaacatatgtagttatgtctacatgcatcagggactgactggatgactgaggattctttgaattaacttttatgaagattacaacatttattaaagaacaagtaattcaaatgtgctaatttgtaacttaaataatatgttattgaaaatcaatagtaatctgtgcaattatttagaacttagactagtagaagcctttaaagacaggactgtttatcagtgatgttgcttagaattactggcatactttgataataaaaaagagattatttttaagttagttttatcattgcttttaaatgctccacaagcaatgcacctccttatcctattgctctgccctaggtaagtccctggaaattataatagtagttaatatttgttgagtaattcagagttaatgcatgtttaatcattgtcatgaataaatcagctgaatgagtaggaatatcccaaatgcctttccaatatgttttttggtggcttttgcccaaggttttttttttttttctcttggtttagaagacttagggctgactattcaataccattgaaaatattagatcaaagcaaaaagaacaaagccagaggcatcacattacctggcttcaaactatactacaaagctacagtaatcaaaacagcatggtactggtgcaaaaacagacatacagaaaatagaacagaatagataacccagaaataaagccacacacttacagccattttatctttgactaagttgacaaaaataagcaatggagaaagtactccctattcaataaatggtgttgggataactggctaaccatatgcagaataaagagactgaacacctaccttttaccatatacaaaaattaattcaaaatggattaaaattttaaatgtaacacctcaaactataagacttttaggagaaaacctaggaaacaccattctggacatagaccttgggaaagaatttagggcaaagtcctaaaaagtaattgcaacaaaaacaaaaattgacacatggaacctaattaaaccaaagagcttctgcacagcaaaagaaactaacaacagagtaaaaagacaacctacagaatgggtaaaatattcacaaactttgcatctgacaaaggtctaattgggaaaatctataaggaagttaagcaattgaaaaagcaaaaatcaaattacctcattaaaaagtagccgaagaacatgaacagacagttctcaaaagaagacatacaagcagccaacaagcatataaaaaatgctcaacatcagtaattatcagagaatgcaaatcaaaaccacaataagataccatctcacaccattcagaatggctattaacaaaaagtcagaaaacagcctgctggtgaggctgtggagaaaagggaatgtgtatacactgttggtggaaaagtaaattagttcagtcactgtggaaagcagtctggagatttctcaaaaaatttaaaacagaagtaacttttgtcccaacaatctcattactgggtatatatccaaaagaaaataaatctttctaccaaaaagacacacatactcacatgttcattgaagcactattcacaatatcaaaaacatggaatcaacctaggtgcccatcaatggtagattggataaagaaaatatagtacatgtacactaaggaacactacacagccataaaaggaataaagtcatgttctttgcagcaacttggatgcagttggagaccataatcctaagtgaattaatgcagggacagaaaaccaactactgcacattcttgcctataagtgggagctaaatgtggggtactcatggacataaagatggcaacaaatgagagtggggactactggaagggaggttttcccctggagggtggcaagaggtgaaaaactaactgttgagcactatgctgacttcctgggtgatgggttcaatcataccccaaacttcagcatcacataatatacccaggtaacgaacttgcacatatacccaccctgaatctaaaataaaagttgaaattataaactaacataaaatataaaataagtagatcaacaagttgagttgggattgtatgtgatggaagggaagaacacatggggtaaaggcaagtctttcaggcttatttcctatttctttgagcatgggtacttgcagctccattccactctcttcataattgtttcctccactatcgaatgacaacatcaaaatatataatattggtaaaagtaatcatattgttttcctatattctttacattagtattatggaaatacacttgtagtatactttttgtttatttacaataatcatttgggagaatttgtctgctgtgaaatagaataataaaaattgttttactcttagtacagatgctagaggaaattctttcacttttccttttcccaccttatttttatcataaaaagagaagatatttaatcctttttctatattttatgttattttagttgctaaatatatagatttggtaattcaattgtccctcgtatcatattactcgaagaaaccctgactgcaagtatgccacaatgccaatatcagcccatatttttctagcttattaactggtctgttctactcagcttcctctatcctacagggccccatctgcagttttaacagtattgatgattaattttacaaagagtagtttaaactgcaaagcagaacctggaactgagccatagagggcccatatgctcagagacatctctaaagcagagaaagaaatgttttcctgaaaatgtttctactatgttggtgaaagatagtctggaagctcctgctctaagtggttttggagggctctagtaataagttagatgactgtaaacttgcaataaaaatgacccagtttaggctctcatagtaactgcatgtcagatatcagaaaagtggagtatttctcacactcaaaaagggagaccattttgccttccatataatttgttatatttttcatctggaactcctttttttgctgaatttccactgttactgtatcactatgcatggcaatatgatatctgcaatatcttagcaatatagaagagcactggatttgaaatttttatttctcacatttatgagtcatgtggtctgagaaacagcttatttttagaaattgtattttcttcatttgtaaaatctgccttctcaggatgattgtgaagattaaataagacgacatgtgttaatgtatctggtgcaaagcatcaaatcagcgtagaatcagaaagccaatgttaggtaacaagcattccctaagtctgtattgcatctgtattcatagctgcctgacttatcattcttgaattatttgatatttaaaggtcaaatggggaaaatgtacctatatttgataaaaaagaggcatcccaagtgtagattagcttgtatagtttaaactttcttttttttttttttaagacagagtctcactctgtcacccaggctggagtgtagtggcgctgtctgcaagctctgcctccagggttcatgccattcttctgcgtcagcctcctgagtagctgggactacaggcgcccaccaccacacccggctattttttgtatttttagtagagacggggtttcaccgtgttagccaggatggactcaatcttctgacctcatgacctcgtgatctgcccgccttggcctaccaaagtgctgggattacaggcgtgagccaccgtgcccggcctaaactttcaaacacatttacttaaattagctaaaacaaggtaattatattttaggtgtttctcaaactaatatggacaaaattatttaatgttaagtttattaaacacatttagaaagaatttgtcattctatttgcctaatttgtctattatttctaattaaatacaatgtaattatttttaagaatagaaaaaagtgagatgaattgattatagagaataattaaaaatgggatataatgtgagcattagtgattatactcttaattctcccccaaataattgactcttattatactattgtttttatttatgacaatagagcataaagaaagaagatattactacaaactcccactgaattcattaatatgattatcatactgttttagtttaaaatatttgtaaataaatttggaagcaacctaagtgtccatcaacagacaaatggataaagaaaatatggcacatatactcaatggagtactattcagcgatgaaaaagaagaatatcctgtcatgtataacaacatggatagaaatggaggtcattatgataagtaaaataaaccaggcacagaaagacaaacttcacctgttgtcacttgtgggagctagaaattaaaacaattgaactcatggagatagagagtataatgatggttacggaaggctgtgaagggtagtggtggtggggagggtgcatgattaatgtgtacaaaaaatatagttatacggagtgaataagatctagtatttgatagcgcaacagggtgactacagtcaacaataatttatcatacatttaaaagtaaccagaagagtataattggtatgtttataacacaaagaaagctggaattaacttcttccaaaattttgttaatattgatattttgacctcctctcatgaatcatgaatgttcttgatggcatctagaatggtgaatcctttctaggggttttcaatttacttttcccagatataccagaagaattactatctatgtcagctatagccttataaaacgtatttcttaaataataagacttaaaaattgaagttattccttgacctataggctgaaaaatgcatgttgtattagcaggcataaacacaacatgaacctccttgtacatctctatcagagctcttgggtgactaggtgcattgacaataagcagcaatatttgaaaaggaattttactttctgagcagtaggtctcaacagtgcgcttatactattcggtaaaccattactattagtaaaccagtaaatggatatgctgtcgcccagcctttgttattctatttatagaacacagacagaaaagacttagcatgatacttaaggaccctaggattctcagaatggcaaactattgctggcttcatttaaagtcaccagctggatcagcccctaacaagagagtcaacctgtgctttgaagccaggcattcacttctctctagctatagaaatcctatataacatcttctaatataaagttgttttgtatattatacacattaatgtatacataatacattagcaatagattttacaatagtttaatgtagtcactttcataaatgatcttaggtagatcttttgaatacatttctacagcttctccatcagcacttgctgtttcattttattctgtttttttgagaccgcgtctcactctgttgtccattctggagtacaatggtgcaaccttggctcactgcaacctctggctcccgggttcaagtgattctcctgcctcagcctcctgggtagctggaattacaggcacctgccaccatgcctgggcaattttttgtatttttagtggagaggggattttgccatgttgaccaggctggtcttgaactcctgacctcaggtgatccacccgcctcagcctcccaaagtgctgggattacaggcttgagccaccgtgcctgacccactttatttttttattttatggagatgacttctttccttaaatctcatgaaccaacctctgctagtttccactttttattctgaggcttccttacctctctcagccttcacagaattgaacatggggctttgtgctggattaggtttttgctttagggaatgctgtggctgctttgatcttctatctagatgactcaaaaattttttcatatcagcaatgaggctgttttgctttcttatcatttgtgcgttcactggagtagcatttttaattttctccaaaaattttccctttgcattcaccacctggttgtttggtgcaagagacctagctatcaacctatcttggctttcaacacgcctttttcactaaatttaatcatttcttgcttttgactgaaagtgagagatatgtgactcttgcttttacttaaatacttagaggcccttgtagggttattaattagcctaatttcaatatcatttatcttagggaatagggaggctcaaagagagggagggagatagggaaatggtcagtggagcagtcagaacacacacaacatttattaagttcaccatattatctgcgcgtgatttatggtgccccgaaacaattatgatagtaacatcaaagatcactgatcacagatcaccataacaggtataataataataaaaaagctggaaatattgtaagaattaccaaaatgttttattattattattattattattattatacttgaagttttagggtacatgtgcacaatgtgcgggttagttacatatgtatacatgtgccatgctggtgtgctgcacccactaactcgtcatctagcattaggtatacctcccaatgctatctcttccccctccccccaccccacaacagtccccagagtgtgatgttccccttcctgtaccaaaatgttacacaaatacacaaagtaagcacatgctgttggataaatggtgccaataaggcttgtgtgatgctgggttgccaaaaaccttcaatttgtgaaaaacacattatctatgaagtgcagtaaagtgaagcagaataaaacaagggatgcctggattgttttgctccatccctgcttctctccttagttcattgcccccccctttttttttttaatcaagatgacttgccatcaaagaaagggaagggtatagaaaaagaccaaataatagactttttttcctgggcaaaatatcaaattaaagaggtaaacatctcagagataggattaatctttaggtaatatagcattctatttctatttaaaatctgtagaagaatttcatatttctataaaaacacaaaattccctctcttccctttttaaaatatttatcatgtagttcacatttttttctttgatagaatgtgttttctgtctcctagctattttcttagtgcaatttccagacaattctcctgcatttgcctcttggaaaagacattactaaataacttttttaggaggtatcattctcagaaagtgatattcttacaaattgcacagagtttgacagtaaaattttatttaataagcatgatacagtattattctttaacaatttatcaaagactgtaatgactctagtttcagacatttttttttctgaaatatatgagctttccctaaaaatctggtctactttcctacctcaatattctacttttgctcttggatttgctgatagggcacagaagacttcccgtggggctggaaagagcttattcttccatgtgggttatgcacaccatggggctgtcattactattactaccaggagactccttaaacactgaggatatatgacagttttcacttggttcaaaaaaaatgatgagttcatgtcctttgtagggacatggatgaaactggaaatcatcattctcagtaaactattgcaagaccaaaaaaccaaacaccgcatattctcactcataggtgggaattgaacaatgagaacacatggacacaggaaggggaatatcacactctggggactgttgtggggtggagggaggggggagggatagcattgggagatatacctaatgatagatgatgagttagtgggtgcagcgcaccagcatgtcacatgtatacatatgttactaacctgcacattgtgcacatgtaccctaaaacttaaagtataataaaaaaaaatctgccagtttctcactaagagttttctcactattaagttttaactcacagatggaattctggttccttttgtccattaactcttcagatattattgcttctaccttggcagtggagtctactgtgattgcttttatgttatatacatggctgataagggggctctgggtgcagttgtaagtaccattgtcacctttccaccctaagtatttgctctgggtgcagttctaaatcctactgtcacctttctaccctaaatatttcattaagcaaacaccttgcagctgtattaatattattacaattttcagtcttttccatttttagacaatgtctaaaaactgtggacaaaacccacagttttaaaatcttaatttatccagggaaggggggccaaaagcacttgcaggagatgaccaggaattaacacagaggaaaacattaaacaggtactgatcagttctatttctaaaatctgtgattaaaaatcagtagcatacccattgaggagaacaataagcattttcattcctaattttgataggattttgaattggactcttccttcctttgtctaacattttagaaaatgcatttcatacagtgaaattgcccccagtactagattttattattttaatctgatttctcataatggaatctgtatatatttcaaaatatgtgttgtaaccttagtcaatgtattataaacttgatatttttgagcaatatggtgatgaaaaacaaggcaatttaatggtctgatgattcagacttgaaggagttgagagtgaacattctataatacaatattcttaaactcaagaccataattaaattatcaattctagatatattttcttcttctaggtatatatctcagaaaaaatataactttgactttcataggagattttattgctctatatctatctgaaagcatgtaattctttagcattacacagctccattagagataaggaggagcatgcaaggcagcgatttgagaacaatagacataacccaataggcttggtagtacgatgtgcttcaatttggatcatgaaaagcattgtagagattattgagtttaacctccacctccaccttttaaagttctttgcaatgtttataacagacgtgcagaagcaaactagaatgatcagaagaaaaaactgataattttaactcccctttttttctttgtagttagtcaaaatattagggcatataaaactaaaaatataccttgataacgctccagttttcaaatgttatttctcttcatgattaaggatggtaatcagaatgaaccttattttccagatgcttctttaagcacactatgtgaagtttctgttgttattaggcagaaagtggcatagatatttctgtgggaatattaatactatgatcaaatcaataacatctgagttgtccccacatactggatattttaagtaaacatttatttattcaacaaatacttactgagtgtcagctatgtagcatgtgctgtctaaattctagataaataagagaaactaaatctctgtcctcatgtccatatatccttgaaggtgtggcaggaaataaataagtgtagactgtaatagatagctataaatgctgcaacagaaaataaaatagaatgagaggacagtgagtgatggaagatgctatttcagatcaattaatgagggaagttctttctgagatgcaccttttgagtagaggtgtaaaatagagaagaagtcatgtgactatttgggataaaagtattcagagaagaaggcacagcaggtccaaggtctcagagactgaaatgtgcaagggaaccagaatggcaggagaggtgtggacagggagacagtggtagaaaatgaggtgagagaagcagccaaaggtcaactgatcaaaagcttctgggtcaggatcacaagacacatacagcttaaactgccttggcctcttttgattcctattaactgtttagaaaaacacattctagttaaattcaaatctttccctactcgaagcacgaactgtgttaacctaaacttgtagaaaaatggaaacattatttttaccaatctcactgtaacttcacgaccacaagcctcaggtgaatggaatgaagaagtttgtcataggtctgtaaggatgagacacattacaaatccaggtaaagatgtagaactagataaaatgtaaggaatgtggggtgggaaatgtgggctgatggtaaaaattagggattcattaatgtacaaatagtatgtgaaggaataagcatgggtagaaagaagtccaaaaactgagccatcggggatcaacatttacagtgtggacagaaggagaggatgcagcaaagggggctaataaagagtgatgggtaaggtatgaagaaaatcagtgggcctgggtatctcagaagtcaagtgaagactttttcaaataatagagtggagtgattaaccatgccaaatactgctaagggttgagtaagaagggattaattattacgtttggcaatgtgaaggtgttcagtggggaaagtctaattgggataggttcaaatagatatggggagtaaaaaggtgaagtttgcaaatttgaacaactttttaaaggagtgctataagaggaataaaaaatagagtggtagttagaacaatatatggaatctagggaggtcttatttttaacagaaaatattatagcatgattgtatcaaaatagtaaaatccagtagagagtgagggaaaaaaactgataatgagagaaagggtataatttcaaaagtaagttctttgagtaggtgagaagaggttaaatccagtgccaaaattgagaagttggcagtaggtaggatctcaaataagttacctttacaactggaaagagagtagaatacaaatgagtacaatgggagtgggtaggtagaaaagataatagaagttcatggaagttctttttggattgcttctcttctatttatgaaatatgctgatgaaaagagtcaaactctgtgaaatatttgaagagatttattctgagccaaatatgagtgaccaatggccagtgacacagccccaggagatcctgtaaacatgtgcccaaggtggttgggttacagattgattttatacattttagggaggcataggacatcagttaatatatgtaagatgtgcattagtttggtctgggaatggggcacaacaggaaacaggggcttccagatcataagtggattcaaagattttcttattggcaatttgttgaaagagttatcatctaaagagctggaatcagtagaaaggaattttggggttaagaaaaggggttgcagagaccaaggttttatcatacagatgaagcctccaggtaataggcttcagagcccttatcaggactaaagaggtgccaggctgttagttaattctcccctggaccagggaaaagacctggaaaggaatgggtattctctacagaatataaaattttttctccataaaagacagttttgcagagccatttatattttagggtaaaatacttcaacgtctttcagagctttctatctgtcatgtaacgctatactagagtcagcctggaatttgttgtcttattgctgcaaaaagtctgttttcttcagtcttaatgtctctgttttaatgtttatgctggtcatctgtgtctgaattccaaagaaaggaggatataatgacatatatcctacccctgcttccatcatgacctgaaccagttttttaggttaattttggaatgcccttggctgaagggagcatccttcagttggttggagggcttagaattttatttttggcttacaaataagagaaaaggtggtaagtacttgagggaaaggagaaaggaaggtatgttggaggtttgagcagaaagaaggtgtgaataatcatctggcatcatgggaaaataaatgaaataagaaaatgcagcatgtttgccagagttttttgacttactttcataactttaaagtcagggtgtagaaggatttggaaatttgcataatgaagacaaaaaacaggaagaatggttcagatgaaaagaaccaaccagatatttgatagctggtatttttcagaaaagcaaaataaacagtggtctacaagtggtgatatggagtaaggagctaatctacatcacctctaagatcagaggcttatgtgttttaggagatgaaatagtctacccatgacagggctggagaagaacaagtgagaacattattttttgtttttttgtgtgtgtgatttttgttttttgttttttttttttgagagggagtcttgctctgtcacccaggctggagtgcagtggcctgatctcagctcacagcaagctccacctcccatgttcacgccattctcctgcctcagcctcccaagtagctgggactacaggcacccgccaccacacctcggtaagtttttgtatttttagtagagacggggtttcaccatgctagccaggatggtctcgacctcctgaccttgtgatccaccagcctcggcctcccaaagtgttgggattacagagagcatattttataattaacatataaatatcaggctatcacaagtgaggatacccacattagaacaaattaaaaatttgtatatgcatatcaaaatttatgcctcgttaacctagagtacaggtgtcaaatgataataaatagtgtttagttttaatttttcattctgatattttatcactgacattaagatggcagcttgatttcctataattgatattttgctatcaagagatgagacagtgttataatttacttgatcttaaggttttcttattgaatccttcctcccatctcctggagtgtagaaaacaatataatggagttttattcaggtggctaaatagaactctccagtgatcgccttttctttaccctaggaacaccaaattgaacaactcaactatctatgcaagaaagaacctttgttagaacccaaaaatctactgtttctttcatttttagtggtcagtgtaagcttcacaaatgtcagaaacatatatggcatgctcttttctatagtctttgtatcttccaaaacgtctggctgataggaattgctattatttgctaaattaatgaatcaagtttgtattattcctattacttcatgttctttctttaatgagattgtaaggttcttaaggagagggagatgcttttatatatgtgtatatatatgtaaaatacattatatatatatgtgactaaataaattaatgagttctggtgtcactttccatgtcaagtcataaaaatcatcaaacagaagcgctaagaatattccacaatttttacttgttttcctttagtctgatattactactcaccctttcctcttaggcattacgtatttgtgcatgctgatgatgttttaaaaataacaaacaaataaaatattttattggtttgttcttcccttaagtcattactgtagtctctctccctcttacattttgaaagagcaaactacatggctgtctctattttcttaacttcatccttcaatgcgtaataatccacatcaatccttactgttctgaaattgcttttgctgaaagcactaatatcttcttaattgcaaatccaaagtccattctcagtgttatttatgtttgctttctcatcagcctctgacatagtagagcactgcctgtagacttccttctttctagaccaggatgtctcctggacctcattcggctttaaaaactatcaagctgttatttcatcaaattcttctctatttcttttaatttgctcatgtaattctaggtggtttccttgactaaaataatccacttttttttttcaactaccaccttgcattctgaagagttatacctatcacctccagctccatatgtccaaatattgctattgaataactgcattagatacactacatgaaccttcaacttggcatgtcagaatgagaagttactatcaccacacagatatctatgttggctgctggaaagggtatatatctagtcccccctatctagaagccttcccctctttcacacccaacaatcaatgtactgtcaggtgatgcttattttaccttagaggtatctatacatacaggattcttgttttccacctttacttctgttctgttgtccgtagcatcttttgcaataatcttctaaatgatctctatcctggtaatttctgcccactccagctcatcctttattctatcaccagaattacaatgccaaaacccaagacagaggtgtttgcttccgtgatttatacctctgttgatctccattatataaggtatgaacagaactgattctggaacactaagccttttaagaatatgttttcaagctattattttagtcctatctcttgttattccggactgactttccactagaaccctatactgcacttgcgttaatgtctattatgtcccagacttaggctttttcgtgagtctgaaattgttcacgcttccttctccccaaagtaagcatgttcttttcctcatttattcattggttgattcaacacaaatattattggatgacactatgcaggtatttttcctcgaaccgaatttatgatatagaaggtaggggaggaagatattaaacaatcactataatgaatgcaaaatttaaatcagagataagtactttgaaagaaaataatatgacaccataagaaagtctgtaaaaagtttttgatcaatcctgggaggaggagatggtagtcagaaaggattaaaataggagaaataaatggaaattaactaggtaagaaatggaggaatgggcattcctgaaaaagggaacagagggaaaacttgtgtggatggaacacagagataaggtggggaaggtggcgggcactgaagttgaactcgtaggcatagcacaggcatagacacagagtacaagtgtctaggttaaaaatattgatattaatcctaacatcagtggatgccttcaaaggggagtaagcataggcaggggtatgcattacataatcagatttgactgtattgtagagaacagtttagagagggaggagtgaattaatgcactgagaaacagtagtgtgctgttgcattggtctagtagagagataatggtaacccgaatgatagtggtcagactggagatggtgagaagtggaagattcaaaaaatatttaggaggtaaaaatcaaggagatttcctgatggattggatatgaaaaacaagggagaaggagaaaaattccttcttccttatgtatcaaactagttcttatcttttaagaccgttcacatatcacccatgcagtttagcattttcttactatcccagcagcaataagaagggagctcatgtctttcaggttcctttggcccaatattcagatctctgcacttaaagtaacttccctgctaaaataactgtccgctcaatggataacgggtttcatgaaagcaatgatcatgtttcattctttttttttaatattccaacatctgatatcataccagtcatataatagacgttcaatgaaattgtttattgactggcagaagaaatctaaatgccatagataattaaagccagcattcattaagaattttcaataaaattttcaataaagtaacatttcaacagaaagttaagagctaatatagataacattttttttgtagatatatctgcggaaataggtttgctccattcaaggaaccattaaatctcaattcttagaaaaagtatttttgtatcatgtgtacttttgaaaattaaggaagagtcagtacactctatttaacattgaaattgtgaagaggcagaaggattcaaaaatcatattaagaaaaattttcactcacaatttttagtttttattcattatctcatatttttttccatttctcttctaagagcttttttgttaactgcacaaatgatatattagcaattattctaaaataaaagtttttagaactgcaacagtattcattccactaaaaatgatacatttaaaagtatttcaagaatgcttttggaatactattaaaatataaaaatgaaataaatgaatgaaggaacatttttaagaggcttattttttcaacaatgctgcctacttcctcacaagacagtgccctcctttcccagccattcaaattttctcatctcttcagtgaatctccatgggtgctgcatctagcactcttcatgttcctttccaaaatcagggaagtactgggatgtgtggtgttttactgaaatgaaaatttcagttacatgtcacataaggatgtttcagccaataacagaccatgtttaccacagcagatttatgagattatagtactgtatttttactgaatcttttctgtgtttagatatgttttgttacacagatactactctgtgctacaattttgccaatagtattcaggactagcctaggagcaataagttataccgtatagtctaggtgtgtagtagggtatactatctaggtttgtgtaagtacacttgatattcacccaatggtagaatcacctaacaatgcatttccagaatacgtcctcattgataagcaatacatgactgtatccagatactggctaaaacaaatcaggaatatgaatagaaatggaacatttatactcatatatgagttgaaaacttttatgttttcaactatttgaaatataaatgcatatggacaaggacaagattatatcttgggaaaaggaagttgttaagttagagataatgtttttaatttccacaaatggtttaattttatgtttttttagacaataaaacaaacaagaatacctgaaagataaataagaaaaactgaagtttaaataaattaatttttagaggaaaaaaatcacctatataaaattcacttgtataagtgagaaggcagaaagacaactgaatatttctcaataaaatgtgatgcctgtttgtcatgaactgtaagagcataaatatgaaaaatcaaaaggttgtcttagtatatgtcataatttcttaaaggaatacttagaaaaatagatattttggaatatatgcttgtggagttcaattttaatttgtaggattgtttagactcagagtacatagtatataaattctgatttccaaaatgagttgctatagtaatatgtgaaatagaatcttaaaaacagtctgtataaaagaaataaatttgagttttcttttaaaatatgtaagcattttcatcaacaatgaatgagaattctgtcgctctccatctacaccagcaattagtaccattgtcccacattaaagtcttgggggatacgttccaaggcccccagtggatgcccgtagcctcagatagtattgaaccctttttatgttctatgttttttcctatacatacatacctatgacaaagtttaatttataaattgggcacagtaagagattataacaataatactaaaataaaacaatgatatcaatatactataattgaagttatgtgactgctgtctctcaaaatatcttattgtactgtagatcttagcaaactcagtgcaaaatatttttcctttcttattaagtcaagtacttaatattttcatttcaacaaagcacatcatggcttccctttggcatatctgcattgccagtgtcactacttttgtgccttggggccatttttgagtaaaataaggttacttgaacacaagcactgtgatattgtgagagtcaatctgaaaatcaagatggcaactaagtgactaacaggcagattgtgtatacagtgtggatacagtggacaaaaggatgattaaggacacaggaaggcaggtgcgaaattttatcatgctactcagaatgggatgcaatttaaaacttatagtttatttccagaattttctatttaatattttctgatctctgaaacagtgaaaagtgaaaccgtggataaggaggaagtactgtatcgtaaatttttccaatcatagctattctatgaggtgtgtagttgtatctcattgttttagtttggatttcctacagaatagtgatagtgagcagttaaaaatctgcttatctatcatatgcatatcttctttttgaggtctctgttaaaatattttgcctctttttaaattcagttgtttccttattgttcaattttgtcttttttttgtatattttggatatgagagtcatttgtatattttggatagatgtcctttattagatatgtatttttaaaatatttcctctcagtctgttacttgttttattattctcctaagtgtcttctgcagaacagactttgtaaatttaaaagactaacatcaagtttttctttcatgcttttggtgtatataaaaactcatcaccaagcctaaggccatgtgggttttctcctatgttttcctctcaaaggtttgtagttttgcattttacatttaaatctattaccaattttgagttaatttttgtttaaagtgtagacttgtaagttttttacttgagtaacaacacagaataataacatttataaaatggggaaaaagcagtttggggattggaggtgggaatacagtttagatatggacatgttaatatttgaagcccctacttgacaaacatatggttaagtaggaagttggatacaaagagtttaattctgatatttccacataccaacactatcaggaagtccaggagtctgatttataacttcaccagcaccttgaactctgtatttccccacctccctttccttcccctacaggcttccaatccccattttatgttttcgggcgttcgttattacttacaataatcttcaaagtatgtgtagggttggaatccattatgactaagtcctattttggtgcttagtctgtgacagagaagctttggctggttgaagaaatttgaccttggtgtgtcctattcaaagtataaaataaggctgggcagtggttcacatctgtaattctagcacattgggaggctgaggtgggaggattgtttgatgccaggagttggaggctgcagtgagctaaaattgcactactgcatttgccaggtgacttggagctaaaattttttcgactccagtgagacttgctgacataaaaagagaaaatatgctttaagcacctagtgcttatgcatggcacatagtagacactcattaaatgaatggttctttctctttccccatagatgggacagtgtgcaccaaacatctgaagaccagttgcttaagtgaaaaagaatgacctgatgtatttcagatcaatattatgcatataataaaaactatgaaatgctaaaagcttagctgcaaagataaaatgcaagaagcttgctggtgaggttgtggtagcaactgaatatatgagaatagattggtacaatcactggatttctataactcagttaagagttggaagtaaagtgtaattctgtttctgtttatgtattaaagtagaaggataatatgtttaattaataaattaacaatagatattggtatacttatagaaatggattgtcacagtttctatctttgagggattaattggaacaaaaatgtactttaactatgaattacctagctccagagatatctattagtagaaaaagattgacaatgaaaagataaatttctatttactacacagcgaaataaatgttttatgttaagagctcatctcatgcatccctgtggcttcagttttcttcaatatctgccactctcagttttatttccagctggaatctattttctgagctccacaactaaatggctgtgtaccaactggacatctctttttgaattattcacaggcatcttaaattcagtctgtgtaaaactgaactggtgaaattgctctttagacctgctcctctagtgtttcccatcttagcaaattgcacaattatttccatccaattactccagctgggaacatacaagatatcactgacttttccctctcttttatttcgatcaattacttcaaattcttattatggcctccaaggctctgcataaaatatccctttctcactttaacgattacagtagactgaaccattataacaaagaaatctcccaaaaagtaagggttcaaacagtagaaatatatttcttgatcttataaaagttcagggtagatgtttcggataaacaagtgcttggctccacactgggacacaagctgatgagatctgcaatctctaatacttagtttccaaggtcattctgagcatggcccaacaatcatcctgaaagagaaagagcataaataagcatgcatggatattttttatgagtgaagcaaggaagtggaacatatttctattctcactacaatggaaagaacttagttacaaagcacacttcattgcaaggaaggctgggaaatgtaatgcatttgggcagccatatttccagcaactatggaagatgaggaaaagaactttggtgaatcattggcggtcccagcaacatttgttgttctttccttctttattctttgtgatccaggtatatcggattttagtctttgattgctctttccatccctaaggactttgtacatgtcattctcttggctcatatgcccttcatctccttcttgattcagctgacaattattattcagaattaagaatgttttacattcctgtggaaagttgttgtcttctttgtaatacttggaaaagctgcaataaattattcaatgactgtttgtcatgctagactgtaagattgaggagtaaaggaactctctgttttgttctttattatattcccaatatctggcacatagcaggatgtttagtaaatatttcttgaactcacagaaagatggatgaatggatgcctggataagtgcaaaaatagataagtttatagatgaatgggaaataagctgatataaccccactctgaaacctttagtttgttaaagaaataattatttaatgacacttgttaagcacgataaggaagtctttattataaaccatcatggtaagtacagggaccactgaaatgggattttgcagtgagggagggagattgggctcaactcttaataaaggatgggcaagtgggaatttattgccaagttgcaaggtgggggtcagtggataaaacatgactaagaggaagcatcaggggtaaagggggttctggctaaattgacctagaaagattcttgctgaaggtaggctagggtgatcaaacatcacttatgagatggtggaggatgagtaaccccagtggataccaaggatgagcagatattgggggtaggggattcttgctaaacatagttagcaaggtatttgctaaaactggattttacaaggaagtgcacagatgaacctaggagaagtttcaagagtctgaataaattttaccaatcagatactttgtatcaagttttctccatgaaggatttgtgcaaaagtagggtaggtgtttgcaaaaagaaaattcgagaagattggtacaaatttgggtagctacaaagaaaaatgataaagagagacaaatgagaaaaagaaaaagtattgttcaacaatgtggaacactcaattgcggttggaaaccacagctttgtagtgaaaactattatattttttttcttgcattcaatttcagagaaaatgcattttggaaataataatggttaataatgcacacagtacattgatccagatatgagcttagcatttaaaatgcagtttttcatgtatattttcaaaacttttttatagatgagaaaactgaaggtcagaaagtacaagtaaatggcataaggagtaaatgacattagcaatcagagaagctctgatttgtacccaagtctgtaatacttcaaaggacagagattgacaaaacaggccttgaagaagtgtgaataacaggaaattaacagtactgtgttaatgtccacacagtgctggttcctagggtcagttgattcaagaaggtgtaatgtttcatcaagatttagtgggatgagatagtagtagacatgtaaagagaggggattgtgctgtgagaattatattttcaaattttggataagaaaatgaattttggaagatgacaaggcctggaatatagacctcaaaagtgttttgttcgaggggaatgggaaagaagtttgtcagatggcagcccacatggacgctgtctttcagaatagtgacaggaattggtggaaggaaagattacaatccagataccaaagccctcactaattgtggcataagggagtagaggtgagttgacgacagtgatgaagataaagagcacagagtatagttcaatttttagggactcaagtatggaggactttttggatgagcatcaagtataatgagaatgaaactgcagtgggtaaacaagagaaagatgaacgtacctcctcacttaaaaatacagagaattaaagcttcttttgaggcttttttgagcaaaatggtattattagaggagaaaaaggttacagttagggtgaagaagtaaaggggaatagtcaagatgttgcatattacaaagaagtttctttgaaataggatgggtttctatgtagttacagtaaagaggtagaagtggaattagatagagaatgataagtctgagaaggagaagatataaattagatggaagagtttgcaatgtgggttttagatcaagggcactagaaagtcaaggaatacagaggaagatgggaagtacttgaaagaaactaactagcctcagggttccagctggggctttgatggcaagttgttttgttgctgccgcaaactcagaccaaagcattctggggaaacttaagaataggaggtggattgccaattaatatctagggctacaagagtgagaagaaatgactaaaaatacaaattaaagttcatataagtggaacaaattttaaagaggaatgggaattttgaggaaaaagtgagaaaaatgtataactctttatttataagtacatattttgcgttatgcactgggtttgtagtgaccaagacagtcttaacatgtcccttagcttgattaaactttagacagtcttcctctggcctttaaggcctgatctccctctgactccctccccctaaagaatccagatggcccagtcacaggagttcctctcctccctttataaagagtatttatttcagataccttataattgcaaattcttcttgtttgctacttgaaatgtaaatttttaaacatctcttatcagttttactacccaccaggcgtatctttctcaaggacctagagctattcctttgaaatgttatcattagggaaaatagtgaccctgtctctcagtctctgtgggagagtaagtgcttaacttcagtggtcacttggctgtaagttgtaaaactatctgctgtcatgaagataagagaaggtttgctttttctttgtgaggccaattagcagacacaggtagcctatgttaccccctttcaccccaatgcttaaaaatcctcccaccctgtatttcagtagagttgagcacagattgatttctggcctctctctcttattgcaattgacttgaataaagtcttccttacctgtttgactttggtgcagcttttgctttgacagtaacttataatgagtttatttttcatttccctaaagaaaaatgtttcatcctgacctccagggcaccatttggtgctggctgatggtggtgtggcagctggagatgtagcataatgatccaaaattgggcccttgtaaaaaaccaaagcacgtacttctaaaatagaatcaattacttatttacttatgtctgctcattataccccagatataaaccccaagggggcagcagtatatcatgaattagagcataagtttttcatcaaagatcaaaactgagttttcatctttcccttgctatttatgtaacttaggtgggttatagacctctttaagcttcagtttactcatttgcaaaatatgaatataatacactatgatattacatataacatataacttaagaacctggttattgcacaaattaaataatatgtgtaaagcacttagcacagcataacagatagttttcacagtttttctttttataagtaatattgttgttattactattatttctttaaagacagggttcatatctgtctaatagtatctactcacctgctcacaaatatttaatgattaaattatttttcaaataatacctagtacatatatacattatctaaatggaagcaaacatatgggatggaaattaacgtctgttgttgaagattgtcttagtagcagttatggtctataaaatatctaaatcacagtttcaagcatgtgttctgagacaaaaatttcaagcagaagcttcctaatgaccacatccagtccccactgagcacacctttaatatattttataatatatattatgccaacatttgctttgtgaacagggtaaagacagtcacagtcaagaattggctaaaatactgatttgtcatttatggaaaagtacaaaggtgagggtgactttcagaggaaataaggcattattagtggtgccgtctggcaaatacaagagaatttctcagagacccacttggaagaaagttcaatcatggcattggatgactcagtgaaaggtggaaggccaatactggtagttcaaatgaaaacatctactgctcttaactttgtaaatattctgtttcattcttaaaagcctagggaaataataattctatacctacttttcctgtttttctgtgaaaatagtttctataaattttaacgggcttagaaacttttctctgaatgatcaaatgtcctaagctatttcaaatcatatttaccctgcccttggacaggcaacaggttactttggaaaaattgagtctttagagaaatgacagaaaagacttttttttcttttatggggtagatcctgagacttctgagcatctataattccttatgataaatatgctattatttctatttctctagagaactcagactgatacatgttctaagtataaaccttggttgatgatctgttcatttcactagtcatgtatttctttactgctctgcttaaacaactggaagctggcttgaacagctagttttttcaaaagtaatttgttattatacatatttgcacagaaagaaaaagtttgaaaaattatcaagagagagctaagtcacttcaggagccacacttatcatgacatgtgatataattacagaaaataaaatacttgattgaagtacttgatgtgggggtagtatactatcaacaatatcaaacttaccttttcttcacttgtgataaatattaaccatctcttgctacatttctttgtattagctctgaaatgaaaagtcatttgaaaaggtattgcaaattcaagttaatgaaaaagatattgaaaatataatttatatgtgcatgagctgctgataattaaaataacaccttattaccaaacacattcttttttttcccttcttaccaaacacattcctttttttccactaacagaaatttaatctaaaaataagtgctttcttctacttttatttactaaagtacttcacagtcttccgtcatcctaatgtcatcttgcctgatgctatttcccctatattattacatttgtcttctcccaggtgtggcatcagtactgatttgctacccaacagccattccctgtcctattctaattgctcatttatatcaatatatttatatctatctatctatatatacatatatatacatatatacatatatatacacatatatacatatatatactatatatatatacacacacacattatatatatatatatatatataatgtgtgtgtgtatatatatatatatcttcttttgcagcctgttttgaagttaccagtgctcaggtgactagtttcagccaagggatataagaaaaagtctgctattgaacatctggccaagatattttttcttcctgataaaggaagagaaatagaaaccaagttttctctttatactttgagctgactccgtaatatagcaacaaaaggtgacgtgcctaaggatgaaaaccaacagctggggatagaaccataaaaaaaaaaaagaaaagaaactggactcttgatgacaatgttgaatcttcaaaccaaccttaggaccagatacatatgggttttctttttcttgaagccgaatgcactgaatcacaagcacttttgtttctcctttctgagagatctgggtattatataaaaatctctgactcaagagatccctctcttgtgtttgaaatattgctgtccactctggattctcagggcatgctctgatgagggccagccgttatcctggctctgcaccccaagcatttggcaagtgctactcaggaagtacccatgagtgatggctcaatgaaagggtgttcgaatgttgacaaccagcaggatccactggactcttccaccggatgaaataataataaataacccaaagcgagcagctcagatgggctagaacactgcctaaaattatcctaaaatcccctgaactagaaagcaaaaaaaaattagctagtgaagagagcacgggagagtcaagtgagtccatgcgtgttgggtctgaggacaaggggcaacagaacagcacacagggtggagaacactcacagccaaaagacatggggaggctctaatttcttaggaagcacgttgcttctcaagtctcagggcggccagtggatcttggtgatttgagtatcatggtgaccatggcaccacagctcagtgctgggtggaagtcgtgccctatgtgcctagtgtctcccttatgcgattgcgtccacacattggagatcctcaggtctgaggtgctccctctgacaccaaaatcactgcccagaacagcatctgttgtggtagtgagaagtgcacactcgacaaatggacaaagatttctattttttaaaaaagatttctctttgttaaaaaatatttctctggaatgaatataagaaattaacagcggtgctcatttgcttgggcaggggaggaaaacagggaacagggttgagcgcagaccactgtgcacctttttaaactgcaaaattttaaaacatcatgaatacgatgcccattcaaaagtaagtaagtttgaagtaactgaagtggaagcaacactgagtgcctgggcagggagtgctggtgtctggtgaggaaggaggagagtacagagaggtgagccctcagagtcccatgcagtctgctgtagaccaagctcagaagcagaactgacctgacccacagctcaccggggagcagaatggccatgaccaacaactgagactggggaaatactcagaataagcaaaagggaaaatgtggaggatgtgccatgccaggtccaaaactgatatacggaatgttttcaactatgaaacgaattaatgccagaatattgtgtttcctaatcactctcattctattatttggctcacaatcaaacttggtagtgctttaaacatagatttgttagtaacgatgaaaaatgagataagcagcatgtggtaataagaaagattacttgggtgtatccagacaacagaggaattcaaaataaacaacataatgagagacttcatcatttctaaggaaacaaagctttgatttttaagattctttcttttgtttaatcatttgaatagaaaaatatagtgcttgaaatttctgaaaattttaaatgttcagttagttacactgagacaatatttctctcatgcaatctgtgaatgctgcaaatcatcaagataaaaagcttataaatacttattcctaagagggctttgtatattaatcctcatctttggaaaacaaccagggaaggaccaggctaagcagaaaagcaggggccagcacaccaccaccctcctgcagggagcacacagagagagcctcctacaggctggagcttgaggtctagagggaggcggtggccagtgtgacacgcactgtccaccatgggggcagggtccatgcaagcactaaaggtggcaggcctggagcagctgagtcccacagggcacctagaggcttgggggagggtgcaggcttgctcaggtcatgaagtcaagtcctttttcaacccttgtgctctccactggggaagagacttgcagaggcatctggacctggctctacaggggcatgggtggcacggttaggctactatactagctctggccaaaaacactagaaacaaatgaaccagcacaggcagaaatgtgacagaagaccatgctggggacctggtcaccactttcaaactctcccaagtgatcaagagatcacttactaggacctcactgttaagagtaaaaagagctaattttacgagaataattagaaaaatcagaagtaaataatgcttaaacagaacctaaaactgtaacaagaccactgggtttttagattggcttttggtctcgacacaaattaagtggatgttattgcttagagaacttgcagtggcctcagttggccttctgcaagcaaattcttcttggagaaagtaggcttttccacaaatttgtcttttagcaatattctaacaaactgcactaaaattgccttgcacaaactatcacaactccacaacaatgcagccttacaatgggccagacactacacatcagtgcttcaaagatgtgtgtccttttgatccagcaattatgtctaggaatttatctgaggaagtaaccagggaagcaaaaatatgcatgttcacagatgctcatcacagtgtcactttgaggaccaaagtggaaactgaaaactgtaggataattcaagagatgatgctttaacctctctatcttacttcctcccctggattccttaagaaaagaaaaacagcaatttctcataagaaaaatatatacaaaaaccctactgatatgggaagatgcccccttcatgtgaggtgtgcatcatagtctaccacagtgtaccattatagctccttcttttgttatgagcaaaattagcatggctggccacagaggaaacatatggaagagcccacacagttggtgatgtgtttattgtcttttggtggaaggaatacaggtcatctttattttctttacattttctacattttcagaacttttgcaaatagtgtatataaaccagaaatgaaaataaacgaaataaaacaaaacaaggtatgtatgtgcaaatgtattctaaatgttatgaggtcccaattccactgatgaggattcctagggtaagaaagctcctagggagggagagctagcaagatggccaaataggaacagctgcagtctgcagctctcagtgagatcaatgcagaaggtgggtgaattctgcatttccaactgaggtacccagctcatctcattgggactggttagacagtgggtgcagcccacagaaagcaagacaaagcagggtggggcattgcctcagccaggaagcagaaggggtcagggagctccctcctctagcaaagggaagccatgaaggactgtgcagtgagtaatggtgcattccggcccagatactatgcttttcccattgtcttcacaacccgcagaccaggagattccctcaggtgcctacaccaccagggccctgggtttcaagactaaaactgggtggccgtttgggcagatgccaaattagctgcagtttgtttttttgtttttgttttttttttttttcatatcccagtggctcctggaacaccagcaagacagaaccatttactcccctggaaagggggcttaagccagggagccaagtggtctagctcagtggatcccaccctcctggagtccagcaaactcagatccactggctggaaattctcgctgccagcagagcaggctgaagtcgacctgaatgctagagcttggtggtggggagggggcagttgtccaccattactgaggcttgagtaggcagtttccctctcacagtgtaaacacagccgctgggaagttcgaacttggggagcccaacacagtttggcaaagccgctgtagccagtctgcctctctagattcctcctctatgggcaggccatgtctgaaagaaaggcagcagccccagtcaggggctaatagataaaacccccatctccctggaacagagaacccgggggaaggggcagctgtgggcacagcttcagcagacttaaacattcctgcctgctggctctgaagagagcagcagatcacccagaacaacactcgagctctgctaagaaacagactgcctcctcaactgggtccctgacccctgtgctgcctgactgggaaatatctcccagcaggggtcgacagacacctcatacaggagggctccagctggcacatggcggctgcccctctgggatgaagcttccagaggaaggaacaggcagcaatccttgctgttctgcagccagtgctggtgatacccaggaaaacagggtctggaggagacctccagcaaactccagcagacctgcagcagaggggccttactgttagaaggaaaactagcaaacagaaaggaatagcatcaacatcagcaaaaacgacatccacacaaaaaacccatccgaaggtcaccaacatcaaagaagaaatgtagataaatccacgaagatgaggacaaaaccagcacaaaaaggctgaaaattccgaaaacaagaatgcctcttccccacaactcctcagcagcaagggaacaaaactggacaaagaatgagtttgatgaactgatagaagtaggcttcggaaggtgggtaataacaaactccttcgaggtaaaggagcatgttctaacccaatggaaggaagctaaaaaactcgaaaaaagtttagaggaattgctaactaaattaaccagtttggagaagaatataaatgacctgatggagctgaaaaacacagcacgagaacttcatgaagcatacacaagtatcaatagccaaatcgatcaaggggaagaaaggatatctgaaattgcagatcaacttaatgaaataaagagtgtgaacaagattagagaacaaaagaatgaaaaggaacaaacaaagccttcaagaaatatgggactgtgtgaaaagaccaaagctaggtttgattggtgtacctgaaagtgatggggagaatggaaccaagttggaaaacactcttcaggatatcatccaggataacttccccaacatagcaagacaggccaacattcaaatttaggaaatacagagaacaccacaaagatacttctcaagaacagcaaccgccaagacacatattcgtcagattcatcaaggttgaaatgaaggaaaaaatgttaagggcagccagagagaaaggtcaggttactaacaaagggaagttcatcagactaacagcagatctatctgcagaaaccctacaagccagaagagagtggaggccaatattcaacattcttaaagaaaagaattttcaacctagaatttcatatccagccaaagtaagcttcataagcgaaggagaaataacatcctttacaaacaaacaaatgctgagagattttgtcactaccaggcctaccttacaagagctcctgaaggaagcactaaatatggaaaggaaaaactggtagcagccatgcaaaaacataccaaactgtaaagaccattgacgctatgaagaaactgcatcaactaatggccaaaatagccagctagcgtcatgatgacaggatcaaattcacacataacaatattagacttaaaggcaaatgggctaaatgccccaattaaaagacacagactggtaaattggataaagtgtcaagaccatcggtgtcctgtattcaagagacccatctcatgtgcagagacacacataggctcaaaataaagggatggaggaatatttaccaagtaaatagaacacacaaaaaaagaaggggttgcaatcctagtctctgataaaacagactttaaaccagcaaagatccaaaaagacaaagaagggcattacataatggtaaaataatcaatgcaacaagaagagttaactatcctaaatatatatgcacccaatacaggagcacccagattcataaagcaagttcttagagaccttcaaagagacttagactcccacacaataatagtaggagactttaacaccccactgtcaatattagaaagatcaacgagacagaaaattaacaagaatattcaggacttgaactcagctgtggaccaagtgcacctagtagacatctacagaactctccacaccaaatcaacagaatatacattcttctcagcaccacattacacttattttaaagttgaccacataattgaaagtgaaacactcttcagcaaatgaaaaagaatggaaagcataacaaacagtccatcatatcacagtgcaatcaaattagaactcaagattaagacactcactcaaaaatgcacaactacatggaaactgtacaatctgctcctgaatgactgctggataaataacaaaattaagacagaaataaataagttctttgaaaccaatgagaacaaagacacaatgtaccagaatttctgggacatagctaaaatggtatttagaggaaaatttatagcactaaatgcccacaagagaaagcgggaaagatctaaaatcaacaccctaacataacaattaaaaggactagagaagcaagaacaaagtcaaaagctagcagaaaacaagaaataactaagatcagaacagaactgaaggagatagagacatgaaaaccccttcagaaaaatcaatgaatccaggaactagttttttgaaaagattatcaaaatagatagaccactagccacactaacaaagaagaaaagagagaagaatcaaattgacacaataaaaaatgataaaggggatatcacctctgatctcacagaaatacaaactaccatcagagaatataataaacacctctatgcaaataaactagaaaatctagaagaaatgaataaattcctggacacatacaccgtcccaagactaacccaggaagaagttgaatccctgaatagaccaataataagttctgaaatggagtaagtaattaatagcctaccaatcaaaaaaagcccaggaccaggtggattcacagctgaattctacgtacaaagaggagctggtaccattccttctgaagctattccaaataataggaaaagagggactcctcactaactcgtttatggggccagcatcatcctgttaccaaaacctggcagagacacaacaaaaaaagaatatttcaggccaatatccctgatgaacattgatgcgaaaatccttaataaaatactggcaaaccaaatccaacagcacatcaaaaagcttatccactgtgatcaagtcagcttcatccctgggatgcaaggctggttcaacataggcaaatcaataaacgtaatccatcacataaacagaaccagtgacaaaaactatatgattatctcaatagatgcagtaaaggtctttgataaaattcaacatcccttcatgctaaaaactctcagtaaactaggtattgatggaacatatctcaagataataagagctatttatgacaaacccacagccaatatcatactgaatgggcaaaagctggaagcattccctttgaaaaccagcacaagacaaggatgccctctctcaccactcctattcaacatagtgttggcagttctggccagggcaatcaggcaagagaaagaaataaaatgtattcaaataggaagtcaaattatctctgtttgcagatgacatgattgtatatttagaaaaccccatcgtctctgcccaaaatctccttaagctgataagtgacttcagcaaagtctcaggatacaaaatcaatgtgcaaaaatcacaagcattcctatacaccaataagagacaaacagagagcaaaatcatgagtgaactcccactcacaattgctacaaagagaatgaaatacctaggaatacaacttacaagggatgagaaggacctcttcaaggagaactacaaacaactgctcaaggcaataagagaggacacaaacagaaaaaaattccatgcttatggataggaagaatcaatatcatgaaaatagccatactgcacaagtaatttatagattcgatgctatctccatcaagctatcattgactttcttcatagaattagaaaaaaacaactttaaatttcatatggaaccaaaaaagagcccatatagccaaggcaatcctaagcaaaaggaacgaagctggaggcatcacactacctgacttcaaactgtagtacaagcctgcagtagccaaaacagcatggtactggtaccaaaacagatatatagaccaatggaacagaacagagccctcagaaataatgccacacatgtataaccacctgatctttgacaaacctgacaaaaacaagcaatggagaaaggattccctatttaataaatggtgttgggaaaactggctagccatatgcagaaaacagaagctggaccctctccttacaccttatagaaaaattagctcaagatggattaaagacttaaatgttagacctaaaaccataaaaaccctagaagaaaacctaggcaacaccattcaggacataggcatgggcaaagacttcatgactaaaacaccaaaagcaatggcaacaaaagtcaaaattgacaaatgaaatctaattaaactaaagagcttctgcacagcaaaagaaactattatcagcatgaacaggcaaccaatagaatgggagaaaatttttgcaatgtatccatctgacgaagggctaatatccagaatctacaaggaacttatacaaatttacaagaataaaaaaaaaaatcccagcaaaaagtgggcaaaagatatgaacagacacttcacaaaagaagatatttatgcggccaacaatcatatgaaaaaaagctcatcatcactggtcattagagaaatgcaaatcaaaaccacaatgagataccatctcacgccagttagaatggtgatcatgaaaaagtcaggaaaaaacagatgctggataggatgtgaagatataggaacacttttacactgttggtggtaatgtaaattagttcaactattgtggaagacagtgtagtaattcctcaaggatctagaaccagaagtaccatttaactcagcaatcccattactgagtatatacccaaatggatatacatcattctattaagacacatgagcacatatgtttattgcagcactattcacaatagcaaagacttggaaccaacccaaatgcccctcagtgatagactggataaagaaaatgtggcacatatacaccatggaatactatgcagccataacaaagatgagttcatgtcctttgcagggacatggatgaagctggaaaccatcattctcagcaaactaacacaggaacagaaaaccaaataccacatgttctcactcataagtgggagttgaacaaagagaacacatggacacagggaggggaacataacacaccagggcctgtctaggggtgtggggctaggggagggatagatttaggagaaatacctaatatagataatgtgttgatgttgatgggtgcagcaaaccaccatggcacatgtatacctatgtaacaaacctgcacgttctgcacatgtatcccaaaacaaagtattataataatataataataataataataataagctcctagggtgggagtttccatagttaataagaggcttcaatgtgaataaattcacaaatacatcagacttagtacatttatcaacagacttttatttccagacgagctcccttaccttttccaggactgagtctggactacaaagacctttagttgtccattagcttcaattaggagacctgcagaaagtaacaacaacaatattaaatgcaatatataaaagacctacaaagctacagttgttaaaaactatcattatcaaagattctgtaaaataacatcacaaaaagacaaatcactgttatgaaacaactctggcaacaaccaggaggatacccagtcttaggagaaggattgaagctgtggttactcctagtgtgcaaatggtataggttacttggaaatggtgtgactatattattatagagtcagtgtgatcatttaaaatcaagatattaataaaagaaaaaattcttacaatagaatgttgaataaaatgtagcatatatttaacacagagagtattaggcaaacattaagaagaaatcttatcagaattgtcagtctcaccctgctaccacatgaaagccagtgaaaaccttttgttctcttcctattctcagtaaaatgtcagtttccaggagcaggggactgactgtcccattccaaaaggaagtcccagaggctgtctggaagtgcgtgtttagggcacacacatgacagcttgaagttcaagagtgtgcatatgtgcaacacactcaaacacccaaagtcaactgtgtaagacaatttaccttgggcagtgggactgtgaggcaggtatggagtatattaatttgagtataaaagtaaacaaaccaaatacattcaagtacactcttacatagaagaaactggggtaacaaattctgacctcatgatgtgaccccaaatggaagtcagaggtcaggaagagtgagggacatggttacaagtcatgtggtcaaaactcaaagcccaacgaggccactggggaaatttcatggtcttccaaacttcacttttctacagaagatgaagaaagtgagagcttcccatgagctcctgaaccatcagagaatcatatccaggttggcttagaaagaccaccagtgagagatctaacatgttcaaaccattgcggacaacctttgccaagccttgctgtgctgcaggcctttttccagtctgacaagaagggtgtgaaggtgccttcataatgaccatttaggccacctgttacacaaagcaaaggccagccagcatgccaggccatggaggaaagcaaggtgcttgcatgagggccctgcagttttcaggtttgggctttgagagatcaggtctaggtgcttcctgggaagtctctatcacactggcctcagcagggttataggaacacaggctctgcaatgcccaggagcctgtcatttcacacttgggccacacttggaaggcactcttaatgtcaccacacctgacgtagaactagcatggagagctgataaaagtatgctttgggccaggtgcagcggctcatgcctgtaatcccagcactttgggaggccgaggtgggcagatcacgaggtcaggagttgagaccatcctggctatcatggtgaaaccccgtgtctactaaaaatacaaaaaaattagctgggtgtggtggcgggcccctgtagtcccagctactctggagggtgaggcaggagaatggcatgaacctggcaggcggagcttgaagtgaactgagattgcaccactgcactccagcctgggcgatggagcaagactccatctcaaaaaaaaaaataaaataaaataaaaagaaaagtatgctttggtgcaaagataaccatggtgggaacctatgtgaccagtcaccagccatggcccagaggccaagaagtaaaattctgttctgggacccattagtgtgttctagatatgatgagatccaagagttattcattaccagaagaggatgcaagatccaagccagttgtgtaaggccaggagggtaaggccagggaggttaggcctgatgggtaaggccaaggaagatgagaaggccagaggggtaaggtgagatagttaaggaaaagtgagtaggaccaagtgagtaaggtcagttgggtaaggccaagacgttaggccatgtgttcaaaagcaggtgaacaagggcaggtagataaggctaggtgggtaaggcacatatgtaaagccaggtgggtgtggccataagggcaatgctgggtggaggataatgccatcagaataaggacaaaaggagaaggcaaataagttaactacaagaagctaggttcagtgaggaaagccaggagggaaaggccaggaagttagagctaggtaggtaaggtgattgaataatgccaggaggcccagttggtaaaggcaagtggttaacattaggtaggtaagaccaagtgaataagccaggtatgtaaagcctcacagataggaccaggttcctgaataaggccaggaagttaataaggccaggagattacagataggaggtgaggggcagatggataaggtcaaggggaattgcaaagggaggtaaggccagaaggctaaaaaaagtgggtaagggcagcacctaacagcaataagttagcttaagcacaccctgggaatgaccctgtggtctaagaagaatatgtgtccagagtttcgggctaaggaatctgggagtggccaacctgcagattcattccttatctatgagggatatcgaaatccctggcctattccatggaatgcaggccttacagaggactgagaccctttgttctgggttaaatgaaagttgccagaaaatgctatataaatcatgtgctttttacaaatggtaatggttctcctgttcagcccactgccattagattgtcctgcatgtaagtcctttcaataaaccctatgtctcattcactggctccaggtcttttctttggcctttgaaacatgatgccattccttttgaagtcaatatgggtctagcatgatgagtgggtaaacttgtccagcaggataggtggggaaagtctagacgttaagtccaggatgtgatatttagaagtcagggacatgagattacataggacaggggataaaatctcagaggtgaggccaggagctgggacccacggaatatggtcaggagtgtacagttaggaggcacagtgtcagaggtaagtcaggtgggaagttgaggctcgaaggctcagacagctgaatgaagctaagtggtcaataccaggtggatgagggcacatgattaaggccattaggtaaggccatttttatgtcctgccaacgtggacataatctcacataggtcaggttggtaaagctcaggaggttaattgcacatgggtagggccatgtgggtgaggccaggaggtgaagtccagggtgttaggacaaggagataaaggccagctgaataaagaggtggtttacatcaggtggtttaggccaaaatgctaggtgggtatgactatgtaggcaacccaatggctaaggatagtggctaatattgggaagttaaggccaggctgataacaccattaattatggtcataagtttaaggccaggtttttaatggcttgcaggaaaagccaggggaataaggcgagggtggtacaaccagaggtgttagggcaagatgagtatgatcaaggggttatgacaaggtggggagggttagggaggtatggccaagggggtaaggtcaggtgctgagtacaagagattaaggccaggagtttaggactatgtggtcaaggccagatgaatacagctaagtggtcaacaccagtttggtaaagccaggagactaaatctagaaggatatggctaggtgggcgatgccagaagattaatatcatgtgggtaaggccaggttggtaagaccatgagtttaaggataccaagttaaggcagtatgattaagtccatgtgggtaaggtcaggggtgagttcaggtgaataagttcagaaactgaagcccaggtggataacctggaaaataaggccaagtgggaagtacagtttggtaaaccaggtaatgaagttcagaatgtcaaggcaaggatttaaagtgaggagtttaaggctacaactttaaggccaagtgtgtatgcccatgtgggtaagacaggtacaactaagcccaagagtttatgagcagtgggtgaatgctaggtggtctaagtctactgaaaacttaatggttaacatcagatgggtcaggggagtaaagcaggtaggtaagtacaagaggttaacactgggaggttatggccaggaggttgaggccaggtgaatgaagctaggtgattaacaccagataggtaagagcatggcattaaagccaggtagtaaggtaaagacattaattgtagatagtattaaagctagtttagtaaggtaaagaagttaattgtagatatgtaagaccaggtaagtaaggtcagatgggtgaggtcaagatgttaaagctaggaggtcaaagttagatgaatcaggctaggttgttaacaccagattggtaacagcagaagttaaagccaggcaggtaaggccaattgcctgaggccaggtgggtaagagcaggaagttaagattgggtgtttgaggcctggtggttaataaaaccattaagtaaggcaggaggataggtccagcagttaaatgccagtttgctaagatcagcagggtaaggatcagtgtgtaaggccaggtaggtattcctagttgaatacagttaggtggttaacatcaagttgctaagtccaggaggttaaggccaggatggtgatatggcttggctcagtgtccccacccagatctcaccttgaattgtaataatccccacgtgctgtgggagagacactgtggaaggtaattgaatcatgggggtgggtttttcctatgctgttctcgcgatagtgaataattctcatgagatctgctgattatataaaggggagttcccctgcgtatgcgctcttgcctgctgtcatgtaagatgtggctttgctcttccttcaccttctgccatgattgtgaggccttccccagccatgtggaactgtgagtctactaaacctctttcctttataaattacccagtctcgggtatgtctttattagcagcatgagaatagactaatacatatggtaagaccaagtaggtaacctggtgggcaaacacaggttaaggctcgtacggcaagaccagtaggtaacctggcattaatatcacagtcataaccttggaggttaaggatagaatgttcagactgatggttatgactgtgatattaatgccaggtgcgtgactttgtatttaaggacaagcgggtaaggctaagaggttgcaaagagagattatggccataagattaagaccaggtgggaaggccaggtggtgaggttttgtgggtaaggcaagggggctgggatgaggcgtataaggtcaggggggcacagtcaggagtataatcctcatgtataaaccaggttggcaaggctagaaggttaatggcagatgtgtaaggccaggtgggtatagccaggggtgaaggcctgggggttacagctaggagcataatgtcagcatgatatagacaggggtatgtggcctgggaagtatgattaaagggggacttccaggggtgtatggccagggggtgtcctggacaagggtgtctaaccaggtgggtaggtacaagaggttaagcctaagagtttaaagcctggaagtccaggccagctgaataatgctaggtggtttacacctggtgggagaggccgtgaggttaagttcagaaggctaaagcttacagggtaaggccaagtgggtgaagccaggagcttaagactgagagaggccacaaggttaataagatcatgtggataaatctaggttcatacatctagattaatgccagttatgtaatgctacttgagttaggacaggtggttaaggccaagtatgtgtggccaggtggttaaggccaggaagttaagactgagtgatacggccaggtggttaatgtggccaaggggtaaggtaacggtctaccgaataaagctatgtgattcatacaaggtgggcagggccacacgggtagggccaggagattgaggccaggtgggtaaaaccagctaagtatgattcccaggtcaaggctgggtagggaggaccccgaggctatggttaggagggtactaccaggaaggtaaggtcagatagatagacatggggttaaagaccttggccaggtcctggctgagcctaagtctcagttttagcagttacacctgtgagaatataatgttcctcatacatcactttattcataggagatgataataatctctgggtcgttggtcttgggaagcactatgtgaaatacaggcaaagcatggcataccactacttcaagttagttcctctcttgtgtcatcaccatcacgatttaatagactaaatgggacaaactcatccttgcactggacaaacgcctactggaggatggccaccttctcacttgctcatttgccccatgtcaagtctatgccagctcctagggcccctgcagatcatctatgcaccccgtccttccctatgacaaatcctgtttattaacttcgtagaagggtcactcacagaagttattttgctactggcttccctatttattaatccttcttcactactacaactaagaaatgaagagatgtgtaaaatgcacagggtcaaggactgaaggtgggaggtggtggcatttgctgcctttggtagggaaatggatttctgttgatgagtgcagccagctgggactgtttcactcctggcagcagtagagcatatataagacaccacaagaaggagatctgtttactgcccactgaggagtcctgccttgagggcaagtcaggctccatcataaagggaaaacacctggggatgcggcactctcaaacacagcctactgcagcaatggtggtgataccaacagttgtgcttgtgtttataaatcacattatgcttctgctcacagagatcaatttctaatctacaccaacacaggcactgcaagagcaatgcaaattccctcctgcctggtcggaatctctggcagcagtgcagaggctgcagccttgccttatccctaaaactcatgcttgctctatccagctacagcctcaactgtgatggccacacctgctgcagccttttcttattctcaatgcctgtgttagcactgtccagctgtagggccaggttgcctcagatgcagctctgcctctacatccagtagtctgccccagctatgacatgaaccctgtatcccacagcaatccactcctaggaaaaccaaagtcccggagaacaacccccacaaccccctcccccaccacaaatcactgtaggaggggagacatacagatgtactgactcatggcagtagtacatgactcatggcagtagtacatgactcatggcagtagtacatgactcattttggggtaccagtcttgttccccggtacagccccttcttctgaaaagtgcttcttcttatttcagccgtgttgctctagagcagctgttctcttgcggcagagagttagctggccaaaagtggaccagcaagacccttactagaagggtaaagtaagaccatgacattgaggccaggtaggtaagtcagtttagtaaggcaaggaagtaattaacaattgtattaaatagataaggcctatctgagatcggatgaaggggctaggctttctccacaagcctcaaatttatgacataaaactggagtaactggaaggtacacagaccaagaaataaaggcagccagttctgataacaagagaagagaatgacgcaaacctataacgtgccagactattgacagaagttttaacatatatggttccagctccatctgcaaacaatcattttgttacagaaaaatgcttaaaataaattcctttacttgtgctcactaaaattgtttgtctcttgtgctccaaaaagaagctaagaaagaaaagtttctggcgtttttaaaacctactgccttgatctgccaattccattgaccatatgtccagcagtcaggctggttacctgataagcacttgtacctcacgcgccctcatccttcctttagctttctccagagagaactagagagtgaatgggtaacagaagagagggtaaaatcaacatccagagcaggctctctgagccacagcactactgacatttgggcttagataactctttgttggggatctttccttcactgcagagtgcttagcagcatccttggcctccacccactagaggccagtagcactctccagtcctccagtccaaccaacatcaacattacaaaatcaccctcagttgagaaacactgacttaaatgcatgatatctggggctatgctgactctaaaacagatctcttcaaagatgatagttaaataaatatacagttggctatattttcaactctaattttcagttaggagcattacacctagaagacagaaaatctgacataaaggagccaagcagtgggttcctgtggctgcttttaaacacctatcatggcagtactagtttaccctgtagtgagttttacaagcacagaaaataactgttacataacacattgtgggtcaaaatctcaaaagaaatgcaagttctttactataaaggaaattggaaaacaaaaataccacttataattttgttcatcaataatgtgaagaacaataatacaaaattttctataaacctatactggagcttggtgactttcttactgagatataaccttgaatggtagacttctgttatacctgaactgacacacacacatacttgacagctgaagatgtggctgacagggttgccagtctccaggagggcaatttgatggtctgaatgtttttgtgcccccctcaaatttacaggttgaaatcctgctccccaatatgatggtatcaggaagtggggcctcaggaggtatttaggtcctgagggtggagctctcataaatgagtttagtgccagataaaaggaaccccagatatctttttgccccttctgccacataaggacacagtaagaaggtgctgtctatgattcggaaaggaggcccttaccagatgctgactctaccagtgctttgatcttgaacttccagcctccagaaatgggagaactgaatttctgttgtctatgagccacagagtttgtgatgtttttgttatagcagcccaaatgggctaaggcagggtcccaccttttgatattcatgcctatgtcatcttcttctcacggaatttgcttctataacctataggagattggaaatgacagaatgtaattctgaagctagacgatttcctgttctcttggatcacttgctttggtgaaagctggtggccatcttgtgaggacactcaagcagccctctggagagaccctcttggtgatgagccaaagcctcctacccacagctgtgtgggtgagacgtcttgcaagcagtctgtctagtccctgacaagccttcccatggctgtagataaggacaacatctcaacttcaacaatgtgacagaccttggaacagaagtgcccaacaaagccacttccaaattcctgatccacagaaactgtgagggataattttttatttccatttgaagtcactaaatttgggggttatttgacagtaatagatacctaacacagtggtgaaagagttttctctagaacataaaaaaaaatgtgtttcttttcgtcaactgggtaagtcattgaatatatttttggagggatcttgaaccctccataaacttagttccatatgaaaaggttattgggatagtcacctaaaagaactagattccaccctccataccccaaacagtgcagcttaaaccttctcatcactgtgcttgatttcctgaaagtctgctccctttctggaaactgatgctgaagaaaaattgaataacctaataaagaccttgtttgttgacaatggtgaagtacagcaagaaccaactaagcagggaattactttagtcttccctgaaaaagaaaatcacaatgttgctggttcaattctattgtggtcaacgacaacaccacaatgaagttgcaaagtcaaaatgcaggtgatattcaagtgcagaagaaagaaaacatgaagttaaagggccaaataaaaggatgaaagagaagagatttaaaaatgataatgacacataaacttgaaaatgatgccacagaacaagaatgctacacaaatctcacttgtagatgtttaccaggcacactgaaagagtccacaatgaccaaccggagacaaagccacaaatataaatataaggaatctgcatatattattgacctcactgcctgacatggtttggctgtgtcctcattcaaatctcaatttgaattgtatctcccagaatgcccacgtgttgtgggagggacccaggaggaggtaatcgaatcgtgggggctggtcttttcatgctattctcgtgatagtgaataagtctcacaagatctgatgggtttattagcgatttccacttttgcttcctcctcatttttctcttgccaccaccatataagaagtgccttttacctcccaccatgatttggaggcctccccagccatgtggaactgtaagtccaattaaacctctttttcttcccagtctcaggtatgtctttatcagcagcatgaaaacagtaaagtggagtgttgctgaaaagatacctgaaaatgtggaagtgactttggaactgggtaacaggcagaggttggaacagtttggagggctcagaagaagacaggaaaatgtgggaaagtttggaactttctagagatttgttgaatggccttgcccaaaatgctgatagccatatggacaataagatccaggctgaggtggtctcaggtggagatgaggaacttgttgggaactggagcaaaggtgactcctgttatgttttagtaaagagactggtggcattttacccctgccctagagatttgtggaactttgaacttgagaaagatgacttagggtatctggtgggagaaagatgacttagggtatctggtggaagaaatttctaagcagcaaagcattcaagaggtgactcgagtactgttaaaagcattcagttttaaaagggaaacagagcgtaagagttcagaaaatttgcagcctgacaatgcaatagaaaggaaaaaccaattttctggggagaaattcaagctggctacagaaatttgcataagtagcaaggagcctaatgttaatgcccaagaccatgaggaaaatgtctccagggcatgtcagaggtcttcacagcagcccctcccatcacaggcccagaggcccaggaaaaaaagtggtttcctgggccaagccccggtccctgtgctgtgtgcagcctagggacttgtgccctgtgtcccagctgctccagccatggctgaaaggggtcaatgtagagcttgggctctggcttcagagggtggaagcccgaaaccttggcagctttaacctggtgttgagtctgcgggtgcacagaagtcaagaattgaggtttgggaacctctgcctagatttcagagtatgtatggaaatgcctggatgcccaggcaaaagtttgctgcaggggcagggctctcatggagaacctccgctagggcagtgaagaagggaaatgtggggtcagagcccccatatagagttcctactggggcactgccaagtggagctatgagaagagggccaccgtcctccagactccagaatggtagatccaccaacagcttgcaccgcgtgcctgggaaagccacagacactcaacaccagcctgtgaaagcagctgggagggaggctgtatcctgcaaagctgcagggacggagctgcccaagaccataggagctcacctcttgcatcagcgtgacctggatgtgagacctggagtcaaaggagatcattttggagctttaaaatttgactgccctgctgcatttcatacttgcgtggtacctgtaacccctttgttttggccagtttctcccatttggaacagctatatttacccaacacctgtactgccattgtatctaggaagtaactagcttgcttttgatttcacaggctcataagcagaagggacttaccttatctcaaataaaactttggactgtggacttttgggttaatgctgaaatgagttaagactttgggggactgttgggaaggcatgattagttttgaaatatgaggacatgatatttggaggggccagggatggaatgatatggtttggctatgtcccctttcaaatctcatattgaattacatctcccacaattctcacatgttgtcggagggactcagggggagataattgaatcatgtgggctggtctttcccgtgctattctcctgatagtgaataagtctcacggtatctgatgggtttatcagggttttctacttttgcttcctccttatttttctctttctgctgccatctgagaagtgcctttcacctcctgccatgattctgaggcctccccagccatgtggaactgtaagtccaattaagcctctttttcttcccagtcttgggtatgtctttatcagcagtgtgaaaacggactaatacactgccttaggaacccacataatatagtcaatgtccattttgactgaacaagagtttacacacggtacacttcaactccacagccagcatcatgattactagttaaagatcagaagcactcctgtcttatccatgtttcctgatagtgcctgtaccagttagaaaaggtaaaaaattatcattatttgccttcatgaaaatcattagaaaaactattataacaatagctttcctttatattagcaataaactagtagaaaatataaaaattaagcctctttcacaatagccataaaaacttagaatacccaggagcaatcaatataaaacgtatgcagaaccaagaagaaagctacctaacttccctgaggaatacagataatgactggaataaatatataacatgttatagggccaaaatattaatattacaaatcaaactgcatgataaatgcaatttaaatcaatatcgcaagttttgagcatgatcttaaagagttgcaaaacagatttttgaagagggctggagaggagtccaactctacaaacagccccaatcaatgggagcctggtccaaatggcttgattgtctggaacccaatccagtctggaatccatagccctcctggaaacagcccttagattctcctcctgagatttccctgtctacttcaccagggcttgtggctcctgggtacccctctgtcagactccaaaatggacaaggaccataactgaatgacacctttctttcacctggccttgagatgagttctgcacccagccaggtccagcaagacacatctgggggatgagcttgttctggacgctggcctgtggaactgtagcctggagttgccaatagtcctcttggcactttaagggagaacatgcctagaaatgaatccaatccctagaggtaaggtaacctccaggatggcttcaaccatcctgattttcagagcttgtagccttgtctgatcccctcctcttatgtggctgacctgctgacttgcttctaacctccagaatcaaaggtgagattaagtctcgagagactgtgactttctctttctctttttctatttccctctctctccctttcttcttcctccgctgctgctgcttctgctccttctccttctcctcctccccccacctctctaacttgctttgagaaagccagccatcattatgtgagctgccccgtggagtggtctatgtgacaagaaactgagagccacctgaaccaggcaagtgagctcaaagtgggtcctgcctagtggcactcagggcaaccacaaactggctgagatcatttctgtagcccctcaggctctgggctcaggacctaagctcttatctgacagaaactgaggtgataaatgttgtttcaagttactaagttgtgggagtagagagatattaggtgaccccccccaacctctgtccttctcacagcccccactttagggaagacttcacagtgctattacaaagaataggatatggctggattataaaaaaatgaatttatgccaggagatttgaggtagagctaaggttcattgataaatatattctaaatggataaaggaatgaagtagaaaagataaagctaacagtgctatatctgagaatggtagggtaaggagcttcaggtcaagcctgctgctgaaaacaatgacaaaatattaataaattaagaaatttgtatacatttaaatctgtgtaataaaatcagagcactccttaggcagggagaagtaaagggccaggatccacacccaggagggaatggaaacccagggaaatgagtcaggaccacttttccagctctggagcacccctattccagtccagcaagagagggactgatgaactgaaactcatagagcttggaaaccaaacctagagctgcccaccggccccccaagaagcgaggcttcaggcaaatatctaactctggggctggaggccccaacagccacaccttgagaagagaaacctagacactggaaggaaacttggctttcaccgagaacaaagcccagactcagattccatgacctcaggattcaggagtagtctccatccatcaccaccattcacagactagccactgagaaaagcaaaatattctcctctgaaggagggcatcattcataggctcagattttctctatagcttttgaataaaaaaagtctaacaatgaaaaaatgccaaagcagacaagaagacaagtcatgaccaaaagaccagatcacagaattaggataatgaaatcactggaagtaaactttaaaataactatgattaatacattgaagaaattaaaactcaagagttagaatttcagcacagaacaaaaaactataaaaacggaattctagaacggaaaaatacaataactgtacatcagacacaactagacacaggtcaaacaatgccctatgatgctggaaaaagcagagccaccaccatacatgagccaacaatgctaaacagcctggtatcatttgacatgtcaaagaaacgaaactttacacgaatgattccttatccatttatttccatcctccaaactaagatttgggcttgtagctccctttccatttgttaaagaagttaaatccatgtgatgaaattgtcccaagtagatcttactgccagtctgaaagaactctgctaatgctgaagtctacagactaggatttcaaagctatttggagttgcaaaaccccatgagattgtttaattttgtgacttccctcctattcaagccttctgtctgttgagagtgggggcacatccgaattatcacaaaatgaggatgaaactacccctggtaatctacagccacatcaacttttgtgctacttatttggacaatattaaacatttttattttatgttgcatactatttcaaacaagatatctacattaaaaaagattttcaaaggaagctctaaaataataacttctaagaatgaataactggattaataaatatctggattaatctaaaagtacaccagaccaaagataggtatgtctttataactgagcctcaaactcaaccatgaagacaaagttagaggttgatttcaccataactatctccctttcatccttctctgcaaaatacagtttaggttctatcgatagagatgtcattagaatctctgtcattagaatattttaattcaaaccgtaatttttctgagaggcaaaagaaatagcatagtctaaaaataagacccacacaaagtactctagtcattaattaacaagcgaagtaaactgttatgcaatagctgaaaagatctgatgggctattccttatgctgttatcatttacctgagaagttccaagaatatacaaactactgttttgaacttaggcctcaaagaatcttggtaatcacagtaaataatgatgaacaaacacatactaattaatgaaatgaagaaaaaaaatttaacctatccaaaaattcactttatttaatgttaaaattcaagatatgttctcttaagtttatattcaaatgagcttatatttccaactcttgctgaatgacagaagcacacataatgttcacattttgctgtaaatgatggacaaagctttaatgtccttcattgataaaggatgggtacaaatcaacagaaaaatagagaaacatctgaaaagaaaaatgagcacaggatatgttcatctattcacaaataaatataatgttttaaaagaaaaatactaaattaaaaatgcaaactaaaaaatgcaatttaaaatcttacccatcaaattgagcaagttttgtgagtttttaaatgtaagaagtgggctgcattccaggctataacaagctgtaggggaggcactactgtcactgaggaagggtagaccaggtatcttgatggacagtccccttggcaagaaaattcttgtccaagatgccaatagcaggagttaattgtattaaatttctggaagtaacccaaaaagctgttgctaggggttactttgtggtgtgatcagacatgaggtttctattacttggcctgtatgagcttctgtgttgattgacacttgttctctgctttctgtccacacagtatatgaatggaagtgttccatttgaattttttttaccttgattatttaccaatttaattcagataaatgaattttaaaggtaaaaaccaagctctgattgcaggggtcagggactgaatctctcccatatgtgctttcccagctagggctgcaccaaaagggctctgtaggctgcttcaagttctttctcctcctctgtctcctcttccatcccttccatccatctccccactcaatctgtgacaagaagcacattcctagtatcctgctagagttttaaatgtattctgacatgactacagctaaagagagagaagcatttttgaaatgaaatgttagctattaatcaccaaggaattaagatattatcacacatttcatacatggctggaaaacatgttgttgtttaaataaaagagttacaatgtcatatgaaatcaacctaggtgcccaccaatgttgggttggatacaaaagtgtggtacatatacaccgtgaaatactacacagccataaaaaagtataatgtcttttgcaccaacatggatgcagttgggaggctgttatcctaagcaaatgaacacaggaacagaaaaccaagtaaccatgttctcacctataagtagcaggtaaactcatggacatgaagatggcaacaatagaaactagggactctagcagggagggagaggggcaagaattgaaaaattgactattaggtactgcgctcagtgcttgattgacaggatcaatcgtaccttaaacctcagcatcacactatatacccaggtaataaaccagctcatgtaccccctgaatctaaactaaaagttgaaataaaaaagaattacgtgttttgtctagatatcttttaaaaatacacaaatatctaatttatttgtgttttagaaacaaataaaaccatcggatttatagttgatgccagggctcacacacactccagcagacgtcaaggcatcctgaaagtcacccaattatcccatagcaatggtatttatgggtttttgaataaacatggaaattgaaacttccagtcttaaaacttgaaatttacttttgtctcatctgagttccaccttcaggaaactctctgtcaggcaagggaccgaaactcactagatcattgtatacagacaatgagatatcagacccttcattccttctgattgcttctcagatagaagataagaagtcccagaatttgtagttggcaagctggagaccaaggagaactgatggtataagttctagctcaggtctgaaggctagtgacccaggagagctggtggtgtaatttccagtctgagtgtaagtcctaaggaaaagaagactgatgtcccagcttgaagatagtcaagcacacaaaatgaattctcattccagcatttttgttctattcagaccttcaatgaagtggatgaagcccactcatattggggagaacaatctgctttgctcagtctactgattcgagcattaatctcatccagaaacaccctcacaggcatatccagaataatgcttaaccaagtatctgggcatcatggccaaatcaagttaacgcacatccacattgctgctaaggacatggttttattccttttatggctgcttagtattccctggtgtatatgtgtcacattttctttatccggtccaccatttgtgggtatttaggttgattttatgtctttgctattgtgaatagtgctgcaatgaacatgtatgggcatgtgctttatggtagaaggatttatattcctttgggtatatacccagtaatgtgattgctgggctgattggtagacctgttttaagttctctgagaaatctccaaactgctttccacagtggctgaactaatttacattcccaccagcagtgtataaacataacctttctccataacctcaccagcatcttgttattttttgactaaataagtagacattctgactagtatgagatagtatctcattgtggttctgatttgtatttctctaatgattagtgatgttgaacatttttttcatatgcttgttggctgtgtgtatgtcttcttttaagaagtgtctgttcatgtcctttgcccactttttaacggagttgctttttgcttgttaatttatttaaatttcttataggttctggatattagacatttgtcagatgcatagtttgcaaatttttttttctcattctgtagggtgtctgttttgcctgttgatggtttcttttgctgtgcataagctctttagtttgattcagtcccatgtgtgaatttctggttttgttgcgattgcttttggtgcttttgtcatgaaatctttgccagagcctgtatccagaatagtatttcctaagttatcttcagagtttttatacttttagattttatatttaagtctgtaatccatctgcagttgatttatgtatatggtgtaaggaaggggtctagtttgaatcttttgcatatggccagccagttatctcagcaccatttgttgactagggaattctttccttattgcttgttttcatccacttcgttgaagatcagatggttgtaggtgagcgggattatttctaggctttctattttgttccgttgtctgcttttgtaccagtatcatgatgttatggttactgtagccttatagtatagttcaaagttgggtagtaggatgcctctgactttgctatttttgcttacgattgttttggctattcttcctcttttttggttccatatgaattttagaatagcttttttagttctgtaaagaatgtcactggtattttggtagaaatagcattgaatctgtaaattgctttggccagtatggccatttttaccatattgattctttcaatccatgactatggagtgttttgccatttattgtgtctccattaatttctttcagaagtattttgttattcttattgtagggatctttcacctctctgagtagctgtattcctaggtattttatcctttttagttattgtgagtgggattgcattcttgatttggctctcagcttggatgttattggagcatagaaatgctactgatttgtgtacattgattttgtatcttgaaaatttactgaaagtatcagttataggaaccttgggcagagactatgaggttttctaggtatatcatctgcaaagagagacagtttgacttcttctcttcctatttggatgccatttctttctttgtctttcttaattgctctggctaggatttccagtaatatgtttaaaaggagtggtgagagtgggcatccttgtcttattccagttttcaaggggaatgttttttgcccattcagtatgttgttgactgtggttttgtaatagatggctcttaatattttgaggtatgtttcttcaatgcctagttcattgagggtttttaacatgaagggatgttgaattttattgaaagccttttctgcctctttaagatgatcatgtggtttttgtttctagttatgtttatgtaatggatcatatttattgatttgtgtttgttgagccaatcttgcatcccaggaataaagcctacatgatcatggtggattagcttttcgatgtgatgctggattcaatttgctagtattttgttgagaatttttatgtctatgttcatcagcgatattggtctgaattttttgttgttgttgtgtctctgccagattttggtatcaggatgatgctgacctcttagaatgagttagagaggagttcctcctctgcatttttctggaataatttcagtaggattggtacctgttcttttttacacatctagtagagtttatatgtaaatcactctggtccagggcttaatctgattggtaagtatttttattagtgtttcaattttggaacttgttattggtctgctcaggcattcaatttctttctggtttaatcttgagaggttgtaggtttccaggaatttatgcatttcttctagattttctagtttgtatgaatagagatgttcataatagtatctcaggattttttgtatttgtttgaggttagaggtaaagtcacctttgtcattcctgattgtgtttatttggatcttctttttttcttcattagtctagctagtgctctatcaatcttattaattgcttctagaaacaaacttctggtttcattgatgttttgtgtggatttttacttatcaaattcattcagctcagttctgatttttgttatttcttttatccctgtaatcttaaagttgttttcctcgtcattttctagttcctttaggtgggatgtttggttgttaatttgacatctttgtgacgtttttagcgctatggttttcctcttaacactgctttaacagtgtcccagaaattttggtatattgtatttttgtttttatttgtttcaaataatttgttgatttctcccttaatttcttcaggagcaggttgtttaatttccatgtaattgtgtggtattgagagatcttggtatttatttctacttttattgtactgtggtctggttggtataattttttttaatttgttgaaaattgctttatggccaagcctgtggttgatcacagattatgtgctatatgcagataaaaagattgtatatcctgttgtttttgggtagagtgttctgtagatggctgttacacattttgttaggtgtcaaatttgagtcccaaatctttgttagttttgtgcctcagtgatctaagactgtcagtgggctgttgaagtctcccactattattatgtgtcatttaagtctctttgtaggtttcaaataacttattttatgaatctggtgctcctgtgttgggtgcatttatatttagggtagttaagtcttcttgttcaattggatactttatcattatgtaatgcccttctttgtccttatttattattgttgatttaaagtctgtttggtctgaaattaggatagagacttctgctgtcctttgttttctgtttgctttttagattattctgtgtgcctttactttcagcctatgggtgccatcacgtgtgaaatgggtctcttgaagacagcatacatcactcctgtttctttattcagattttcactctgtgccttttaagtggggcatttagcccctttaccttcaaggttaatacggatatgtgcaaatttcatactgtcatcatattgttaattggtttctaggtagacttgatggtctagttgctttatagtgtcagtagactatgtacttaaataggtttttttcatggcaggtaacagccttttgtttccatgtttagtattcccttatagaccttttataaggaagatctggtagtaataaattcccttagtatttgcttggatgaaaagcattttatttctcctccacttatgaagcttactttggctggatatgaaattcttacttggaatttcttttctttaaggatgctgaatataggcccccaatctcttctggcttgtagagtttctgctgaaagttctgctgttagcctgatggagttcctttttatgtgatctgccccttctcttcagctgcctttaatattttttctttcatgttgaccttggagaatctgatgctatgtgttttgggcatattcatctcatatggtatctcactagtgatctctgaatttcctgaattggcatgttcacctctcgtgagcttgaggaaatttttatggaaaatatctacaaatatgttttccagttgcttgctctcttttcctctctgggatgccagtgagttgtaggtttggtctctttacataatttcatacttttcagctgttttgctcactttacaaaattctctttattctttttttttttttttttttttttttgagatggagtctcactctgtcactcaggctggagtgcagtggcatgatcttggttcactgtaaccttcacctcctgggttcaagtgattttcctgcctcagcctcccaagtagctaggactacaggcatgcaccaatatgcctggctattttttttttctgtattttatgtagagacggggtttcactatgtttgccaggctggtctcgaacttctgacctctggtgatctgcccacctcagccttccaaagtgctgggattacaagcatgagtcaccatgcccagtcttctttattcttttctgactgagttgattcaaagaactggtcttcaagcactgaaaatctctcagcttggtctattctggtgttaatacttctgattatattatgaaattcttgtagtgagtttttcatctctagaaggtcagtttggttctcaaaatggctatttcatctttcagctcttgtatcattttgttggattcttttagattccttgtattgggtttcaactttctcctgaatcttgataatctttgttgctacctggattcttaattgtacatttgtcatttcaaccatttcagaccaacttaaagaaccattggtggggagctaatgcagtcattcggaggtaagaagacttcctgacgtttagagttgctagagtgcttgtgctggttctttctcatctgtgtggcctgatgttccttccttaaatctttaaagttgctgtcctttggatggcactttttgctttcatattctttgatgaccttgaagggtttgttcatgttatgagttgggttttattgattggtttcatttctggattatttcagggggctgaggttcagaagggcagaggtgttcctggttggctggcaacaaaactctgatgacgagtactggcaaaactgtttcaccagggaggtggtgggctgcagtggttcccgtatgtgtgcttgcaccagtggtggtgggcagtgatgggtcctgcatgtgcacatgagccatcaaagcagtggaaggaggctatgggtgagtgcagactggaaggggaaggctgtgcatgggtgcatgcccaaagggacctatgtgcagaagctctctgactgttaggtgggttttgctggcaaaaggcctgtggcattagctgctggtaagccctgcagatgggcagctgaggctgcactgtaagaggtggcagacaggctgggaccctgggataggccagcaggcatgggggacacccagatcatactatccctgtcccatgggcaagatagccctattctgtcccagtctggcagataacaaaggctaaagccacctagatgagtacagagagctttgggggatcggcaccctttactgtgccccactgcagccattcacataccaaaatcttttggattcatgaaggctgaaattctgtcattgccaactctctgggacattccccctgccatgtcaaatgttcattatggtcgtggggtctcctgcaactaggattctggggatctgtggtgagagtgggccactctatgcctatttcactcacccctctcccaagatccccttggggccaggaatgagtcctggtgctaggcaaccatgtgcatggtgtcccagctttctaccttttcaggccaggtttgaatcctccctttgtccactctcagtgccttgttttcaaaaatctgtttggactatccgagcctacttgatgatctggcctcttggtgggagaagttcttcctggctgcatctagttggtcatcttagctccaataaatacttctgattattttctgtgggcgaatacctgaaggttttgggaagatcgggaagatgtactgaagatgtcaatttcaggaaaagtaacatcatgctaatggaattttgtcaagtggcctttgttatccagataaaaaaaaatttggatgatgggatagaaatataatgccaggatatacaataatatattgtttctgaataccttatggaaaaatgcctaattttaggatttctttgtattatttaattttattttaatcattttttaaatacaggtttctcaaaaataagtagtgctgagtaatttcatttgacttaaagtctaaatgatcaaggaatattcactattgtttttaaatttttctatatggatgctatcatgaagtctgtaacaatgaaagaatccaatttatgaaataatcttatttccaaatattctctatacaagataaattaatgtttctaaacaatgtgtttggtcattttgataagacttggtcaacttggcaacttttactacatcagtaactgaaatggtatctctgagcattagtgttttcattttttgaatctctttattgactggtacttccagaaagtgatggataaatatttttgcagaaaaatcctgccattttcttgagaggtcactttgattaagcaagatattaaaaaattcaagaaatttataatctcttcttagccttttggctaagattatgtgaataaatctgtatattattttattttgtaaaagaaagaaatactctttattcaaatgtcaatgtgttgtaagcatcaatagaatataataaaaccaatgtaaagaaagacttttaaatatttttccctttagaggccaggtatggtggctcaagcctgtaaccctagcactttggagaataaactttacagttagcctagaacatttataaagaacatggacattgttgtcaaacaaacctggattctaatttgctgcttttatttacctcttgcctttacttgggcagggtattctaaactatcacatattcagacatgccattattcaataatgaagggctactgttgtagcaccttctttcccattaatctttatgccttttccctcctccctcaatttttttttgatgagggatttatttctacatgacatttggtgaatatatgtatgtatgtgtatatctttacaaccacacatatatgtatgtacacttacacataaacatacatgcacacacaaacaatatgcccagaatatgtaacaatgcctgacgcatagtatgtaatcaataaatatttgttcaatcaatacattgtaaatttaattcactcataaattatactctgtttcatgcctttgcactacaatatatttgataaagaatattataaattattggccacaattccagtctcagaggttatgggtagcatcaacacccacatattgggaccctagagaaaagatggccaaagcagcatcctacccacaaaaattatctaacaagtccactagctaagtataccttcactattctttttttctctatgcttctgcttgattatatggtgttcgttttttaataattattacagaatgcttattatagatcattaggagaagtataagaataaaagtaaaaacacactcaaaactccatcactagacacctgcttttataatttagtgtggactgtatttccttctattttttgttttctttaagacggagtctcgctccatcacccaggctgaagagcagtggtgtgatctcggctcactgcaacctctgcctcctgggttcaagcaattctcctgcctcagccacccaagcagctgggattgcaggcacgtgccaccactccagctcatttttagtagatacggggttttaccatattggccaggctagtcttgaactcctgacttgaggtgatccacccactcggcctcccaaaattctgggattacacgtgtgagccaccatgcccagcctctttctaatatttttaaatatacatttcctgcctccctccctctcctcccttcttttcccttcccctgcccctccccctttcctcccttcccctcccctcccctccccccaacctccttccctcctctcctgccttctctggtttctctttattccttcccataattgatatcatgttatatacttttatattgtgtatatgcacttttacctttaaaataaatttccagaaaagttttctcttcatttccatcaaaagattcccatttatccaatctctatcttacagcaatatcatttaaaaatggttgttaattcttgttaatgtgatagatgaaaatagaatattaatattgttactcaaaaacatatttaagcatttcaaaaatctgtgaaattatttagtttttatttttctgtttttaccgcttttaagtttttacagctttctgctgtagattccttattctttctatgcacacccatgacttctacaaataattatattctttttaatctttataactatttgtgtcctatttcactggctaggaccttcagaataatgtcgaattgaaggtgacagagcatatattattgtcttactcctaccatagatagaaagggctatcaacatcgagcaggattctagctataggttttttataggtcaccttatcatgttgaagaagcttctttctatttctgcttgctgagagttgttattttgaatgattgttgaactttataaaaacaattaatgctcctgttaaaattatcatatagctctttttctgtattctagtaatataataaaatctattatttgatatatggttgctaacaatcttcattccccggtaaactgcacttagtcattatgtattatcccttatatatattgttggatttgatttgctaaaattcttttcaagattttagatctgtgtttatgagagatacttatctgcagttctctgcttttataatgtctttgtctgattttgatagcaaggtcatgctgaccacacaaaataaaatggaaacttcctcttctatttactgaaagagttttttgtgtgaaattagtagtatttcttcctaaaatttttgatagaatttgaagtgaagccatctggacctgaagttttctttgatggaaggttttaagtgataatatcaatatttaagattgatataagagtattcattcttttttttcttcttgaattagttttggttcatctatgtcttccaagaaatatgtatattttatctaggttgtaaagtttatttgcattaagttggtaaaattatttccttattatactttttgtgtgtgaagagtctgcaattatgtcccctctttcatttctaatattattaatttgtatcttcttttttttattcatgattattctgggtagagatatatcagttttatcaatatcttaaatgaaccaattttagctttattgatgtttcactactgttcatttgtatttcattgatttttattcttgtcactgtttattttagtgaatatggatttattttgcctttcttgacaaatttcttggtgctcagattattggtttcatttctttgcttttttttttagtattagcatttagtgctgttaatttccctctaggaactgctttagttgcatttttaaaattttggtatgttagattttattacatttagttaaaaataatttttatttcccttgtgatttcttctttgatttgtgaattgcttaaatatgtgttgtttaatttgcagtatttggtggtttcctattccaatgtagtgaaatctttttaatttattaattcctgttttatgttctatcctagtaatgtaccatgtacatttgaaagaaatgtgaactctactatttttaggcataattttttgtaattttcaccaggacagttgataatactgttcaatttttctacatatttgctaatttgtatatctagttgttctaataattgttgagaaagaggcgtcagcatgttcagctatgaccatggagttatctctctctccctataattatgtcaatttttggtctgtctttagatgcatacacattagtgatttttattcctcataaattgacattttattataattaaatattcctctctctgcttatacattagtcttatattttatgtgatataaatacagccacttcagcccttttatgtttattgtttgcatgtcgtattcttttccatccatttacttttagcatatctgtgtctttaaagaatactttttttttacagcatgtaattgtgttttaaaaaaattcattccaacaattttactcttttttagttattagttttcgtttgattagtctatagtatttaatgtaattatatatatgactggattttgtctatgtcttcataattgttttttctactttcctcttctgatttttttttctgttggttctacactcttgacttttttggattatttaagcatgttaaattttttaaaattgttttggttattttaggttgtacttcttcattttaattaattatttttaaaaaaagtttgctctagggattataataaacattgttaacatttgtagcccagtcagtgttaaacttgtacagatccatgtaaaatacaggaatcttacaaatgtatagatcgtttcctaactgattatgtatattatagttgttatatgtactacatgtccaaaatttatatggtaatatgattattcaatagtcatttggtcgttatttcttaaaatattttttctgtctcattcttcctcatcctccttctgacattgccattacctgtatgttaggccatttgatatctaacagatccccgaggctctgtttccttctttcaagattctttagtctgtattttagtgttggataatttctattgagctgtcttcaagtttacctacttttttattgtgcgctctgtaggctgttcaaaccacagccacagaaatttttaatgtcagatctagcattttttagaactacctttttctgttctagagtttacatttgttcttttttattggctctagtctgctgaaatttcccattttccattcatgaaaccatattgcatttcctgagggtaattacaatagccatttaaaaatccttgcctgttagttttagtactgacttcatcttatgtttggatttagctgattttctttctcttaagaagttgcttattttcttgattctttatatattagatcatattggattaaattctagacaatataaatattaaattatggaaattctgtattcttttatttttgtacagtgggcagtgttttgttggttttagcaagtaattatcttgactgaggttgtattacaaacttttttttggggatggcatctccagtctaatgttagacactttgtctttgacttagtcgttttgagtttattcaggacacccatggctcagaagtcagcaaggatgtaactgatagaatttgtgtcaccccattctaaattttcttttcttaattcttccattctcttctgaaactatggtttccccatctaaagaggctggatttttttctagcattgcttttgacaccagtgtgcacttaaaaaaataaaaaaggataaaagttatgaaaacggggaaagtatattgtacagctctcctcctcctctctttaagcctaaattgtcaccagaatctgtttgcttttgttcactctctagttctttcagggagttgctttttgaattcttattttctgtgatacagtcatctaatatgatcttattctgttgtaaccgaaatggaaacaaatggtattattttaaaactatattgtctatttgtgttttcttttttcctgatatatacatgtagagagagagagacacagaaagtagaatggtggttgttagagtgtggggcagttatatatatgtattataaacatgcatatatatatgcattataaacatgcatatatatatgcattataaacatgcatatatatatgcattataaacatgcatatatatgcattataaacatgcatatatatatgcattataaacatgcatatatatgcattataaacatatatatgcatattggtctttgtaaatcctcattgatttctatatatataatttcattatacatataattttcatttatatatatttactgaatatgtatattgaaattatacatataaatgcatgttgacctctataaatcctcttaatgatttcagaagttttcttgtagtttcttttggagtttccattttacactatctctaatacaatgttgactagagtcggtgatagtgagcattcttgatttattctcagtgtcagcacaaaaatatgcaataactgaccatttaatatttcttttgaaatactttttatcagataaggaggtttctttctatttattgcttgtaaagtgttttatataaatagctattgaatttttatcatattcctttccacatttattgaggtgactgaaaaatcatataattttccttttttctgtaaatataatgaattacattgatttttttaaaaaaaatcacatttgcattcttagataaagactaatgattgcaatatactatcctttttataaattgctgccttcaaattactaacattttatttaggaggtttgtatgtatgttcatgagttggataggtatttaatttttttcttttcatattatcatccagtgttagaatcaaatttatttttgttctcataaaaataggtgttgagaaatactttccttttgctattctctggaagtttgtataagattcattttatgtagctcttaataatttagagtaatttatcggttaaatctcctaggcctcaagtttttcttacagaatagtttaaataatgaatccagttaaaaatcggtggctcacgcctgtaatcccagcactttgggaggccaaggcgggcggatcatgaagtcaggagatcgagaccatcctggctaacacggtgaaaccccgtctctactaaaaaaatacacaaaattagccgggcgtggtggtgggcgcctgtagtcccagctactcgggaggctgaggcaggagaatggcgtgaaccagggaggcggaacttgaagcgagccgagatcacgccgctgcacaccagcctgggcaacagagtgagactccgtctcaaaaaaacacaaaaaacaaacaaacaaacaaaaaaccatataggagtataatatttaaatacttcttttttggggggaggacagtttttcccccattttaatcatttgtaaacgtacagttcagtggcattaagtacattcacattgtcatgcaaccatcaacatcacacatccacagaacgcttttcattttgcaaaactgaaactttgtatctattaaacaataactctccttttctgctgtcccacactctaacagccaccagtctactttctgtctctatcaattcgactactgtaagcgtaccttgcgtaaacttacgtggaatcaaactgtatttgtcctttagggactggcttatttcacttagcattatgacttcagattcattcatgttacatatctgaattttcttcctttttaaaggtgaataatattttgttgtgtatatatatatatgttttgttcctcctcttacctgtcaatgaacatataggttggaattctttcaaatttggcaactacaaataatgctgctttgagtataggtgcacaaatatctgttcaagtccctgctttcaattcttttggtatatactcagaagtagaattacttaatcacacggtaattgtaattttagttctttttaggagttgccatacttttttccgtagtggctgcaccattttacattcccatcaacagtgtataagagttacaatttctccacatcctcaacaacacttaattttctttcttttcttctttctttctctttctttcttttctttctttctctctctctttctttctttctctatctccttccttccttccctccttccttccttccctccttcctatttctctctctctttcttttttctccttccttccttccctccttccttcctctttctttctttctccttccttccttccttccttccttccctcccttccttcctgttggtcttgctttgcttgtttttttctctctctctttttctttctttttaaatagacatgataatggatgtgaggcggtatcttactgtggttttgactgtgcatttaagtggtaccttattttacatttccttaatgactagtgatgtgaagcatccttttatgtcctcattggcatttgcatatcttctctggagaaatgtctattcaagtcgtttgcccactttaaagtcagggtttgttgttgctgagctataggaattctttaatattttgaatattacttccttatcagatatgtgatttgtaaatattttctctcattttgcgggttgccttcttattctgttgataatgtcatttgatgcacaagtttttaattttgatgcagttcaatttgtctactttttctgttgttgcctgtgtcttcggtgttttagccaataaatcattgccaattccaatcttatgaagtttttcctttatgttttcttctaagagttttgcagttttagcccttatgtgtagacctctgatttgttttaatttttgtatatggtatgagggctcaatttcattcttttgcatggatatccagttttcctaacttcatttgttgaaaagatagtttcttccctgttaagtagtctttacacacttgtgaaaaatcatttgtccctttaagtcagaatttatttatgggctattctattctattggtctgtttatccttatgccagtaccatattttgacaagttgtggttctaagaattttctatattctgtaaactgtcaaaattaatgggataatatctgattatttttaaatgtctaatggatctgtgattattccccatttttactttttatgattgataatttgagtttttgctgtttttcagcaatctttttaggaacttatcaattcattaacttttgaaaaatcatcttttggttttattaaagttcacttttgtatgtttgctttctatttctgtgatttatatttttaattgctctcatgtcttctcaattcactgttacaaaatattcttctattttctatggaaagttattttataaggtaactacaattttcaaatttcattacttgtaattttggtccttgaatttctaaaataactatataattcttagagaaacaggtatgttcctgaaaaagaagtgtataataatttacttgagttgtgcaaattataaagcagtaaagtatgtattaatgactaacactaattacaccaggtctattttctacatatttttcatgcttcaaatttcttcgtcagcactcagtgcagaaccatcctttgtttagtgattgcacattcagagctgtggcatgaaggctaactgtgttgaaaatataagaaagcaaacacaaaaaagacctattaaccataatcgaaggcacatttatgccatacaatagattaggtagttaattaggttaaatgttgaatttcaaaggtgagaaatgtgtgctgctgcttactatcttttccaaaaaggtggctagaccattacacagaaggagtaatttcttctgagacagtggaattctatttacactctattaaaatataaattttacatcagtccaaagcttgtatccagaaattaaattactagccattgtgctctgggaggtaattacttgaaaatctgattaattctgaattaatttttaatgcaggtagaatattaaatgattataaagagcaaaaaaattatcaagacagccgtaaactgtcttagtttagactcaagacactctttactttctacaaagtatttcagagagaaaaaatagataaccctggcatttatttcattatttgattttatcagcgactccaggcattcaactcagctaagataaaattctaatctaaagatgtgtttagattcttttctccttgaaagtctgcttaataggaactaaagaagactttaggtaagtgaatgtcctataatttgtcaccttcttaaaaaatccatctattatggaaaatataatgtatgatttcaaactcaggattacaaaaaaggtaaaatcattgatagaaaattccaaaactatttaattttttatgtataatttcaagtttaaggaacttcagaaatgtttatcatgtcagggtatatcagtccatttgcattgttaagaaggaatacctaagactgggtaatttataaagaaaagaggtttattttggctcaagtttctgcaggccatattggaaatgtggtgccagcatttgcttctggtgagggcctcaggaagcttacagtcatggcagctggtatgggggacaaggcatatcacatggcaaaaaaaaaaaaaaaaaaacaagagaaagcggggaggtgccacactctttaaacaaccagctcttgtcaactgccagaatgagaacttaccatggagatgacatcaagccattcatgaaggagctgcacccatggtccaaatatctcttatgaggtctcacctttgatattgggaattacatttcaatatgaggttcagagaggacacacatccaaattatattatgtgcaccattgccttttattattttttaatttagcaaattcagattcatacttttttttgatgctcataatttgatggtcataattttccttcaaaatgctcaatccttatgttttgttatggcttttagttgtcaactttctaaaattaaccctattctttcaggtgggtttactctggtatccaaataatccatatactttttcattgcatgagcatgcagatgaattgataggcagatccatatactactgttaatgacaatcttttgtcttggttgtccaaagttgccaaatttctatttgagcaatagttttgctcttagcaaagaatgttactcttgggaaaaaaagagtgaggttaaaatttttcctactgtttcatttaatataatttttatgtaacatttatctttccttgcacctttattggccattgaccttttcttttggctgatctcttcctgagttgttcaagatcctaccttagttctccacatatacttgtctttatcaaggaaaactgaggtcctgaatttttctgcttttctaaccattaaaatattaacttaaactgtgttccatcattttagattccttttgaagatactgataatctgtattaacagctctatgaaatttatacttctccaaaggggacaaatttttagtccaagtcttagatgttttttagttcatttttttttttttttttttagttcattctaggatcattatttcacctcttactgaggtgactaatagcacttgatttgaatactacaatatttagatttatgtattgggtcaaaaagtgagaaatatgagtcatccattttaaattaatattgtgtgttcatgtatgtatagacatacataatacatacatatgcatgaatatatgtacatatatgacaatatgcattgtctgaatttatattttccagttatattctagttagaacatagaaaatgtactaatttcagtaatattttaataaaatcatagtaaattcatacttttatgggattttgtgtgtgtcatataaaattttttcacttatttgatgtaatgtgttatgcagcaattctgtagaaccagtctggttgtgagagggctggtgaggaaactttagtggaaaaaaaaagttctttggaaatcaaacatttgtcttgcatggattgctgcaccatttggacaacattattctagtttcttgtttatatataacctgagattttgttcactacagttaagaaactgaggtgcagacacaaagaaattggctgattggttggtaagctattaattattgcctcaatttcagagcctcttattggtctactcggagattcaacttcttcctgggttagtcttgggagggtgtatgtgtcgaggaatttatccatttcttctagattttctagtttatttgcgtagaggtatttatagtattctctgatggtagtttgtatttctgtgggatcagtggtgatatcccctttatcattttttattgcatctatttgattcttctctcttttcttctttattagtcttgctagcagtctgtcaattttgttgctcttttcaaaaaaccagctcctggattcattgattttttgaaggttttttttgtgtgtctctatttccttcagttctgctctgatcttagttatttcttgccttctgctagcttttgaatgtgtttgcttttgcttctctagttcttttaactgtgatgttagggtgtcaattttagatctttcctgcttccccttgggggcatttagtgccataaatttccctctacacactgctttgaatgtgtcccagagattctggtatgttgtgtctttgttctcgttggtttcaaagaacatctttatttctgccttcatttcgttatgtacccagtaggcattcaggagcaggttattcagtttccaggtagttgagcggttttgattgagtttcttaatcctgagttctagtttgattgcactgtggtctgagagacagtttgttataatttctgttcttttacatttgctgaggagtgctttacttccaactatgtggtcaattttggaaaaggtgtggtgtggcgctgagaagaatgtatattctgttgatttggggtggagagttctgtagatggctattaggtccacttggtgcagagctgagttcaattcctggatatccttgttaactttctgtcttgttgatctgtctaatgttgacagtggggtgttaaagtctcccattattattgtgtgggagcttaccaaccaaaaaaagtccaggaccagatggatttacagccaaattctaccagaggtacaatgaggagctggtaccattccttctgaaactattccaattaatagaaaaagagggaatcctccctaactcattttatgaggccagcatcatcctgataccaaagcctggcagagacacagcaaaaaaagagaattttagaccaatatccctgatgaccatcgatgcaaaaatcctcaataaaatgctggcaaaccgaatccagcagcatatcaagaagcttatccaccatgatcaagtgggcttcatccttgcaatgcaaggctggttcaacatacgcaaatcaataaatgtaatccagcatataaacagaaccaacgacaaaaaccacctgattatctcaatagatgcagaaaaggcctttgacaaaattcaacaacgcttcatgctaaaaactcaataaattaggtattgatgggacatatctcaaaataataagagctatctatgacaaacccacagccagtatcatactgaatgggcaaaaactggaagcattccttttgaaaactggcacaagacagggatgccttctctcaccactcctattccacatagtgttggaagttctggacagggcaatcaggaaggagaaggaaataaagggtattcaattaggaaaagaggaagtcaaattgtctctgtttgcagatgacatgattgtatatctagaaaaccccatcgtctcagcccaaaatctccttaagctgataggcaacttcagcaaagtctcaggatacaaaaccaatgtgcaaaaatcacaagcattcttatacaccaataatagacaaacagagagccaaatcatgagtgaactcccattcacaattgcttcaaagagaataaaatacctaggaatccaacttataagggatgtgaaggaactcttcaaggagaactataaaccactgctcaaggaaataaaagaggatacaaacaaatggaagaacattccatgctcatggataggaagaatcaatattgtgaaaatggccatactgcccaaggtagtttacagattcaatgccatccccatcaagctaccaattactttcttcacagaattgggaaaaaactactttaaagttcatatggaaccaaaaaagagcctgcatcaccaagtcagtcccaagccaaaagaacaaagctgaaggcatcacgctacctgacttcaaactatactacaaggctacagtaaccaaaacagcatggtactggtaccaaaacagagatatagatgaatgaaacagaatagagccctcagaaataatgtcacatatctacaactatctgaactttgacaaacctgacaaaaacaagaaatggggaaaggattccctatttaattaatagtgctgggaaaactggctagccatatgtagaaagctgaaactggatcccttccttacactttatacaaaaattaattcaagatggagtaaagacttaaatgttagacctaaaaccatcaaaaccctagaagaaaactaggcattactattcaggacataggcatgggcaaggagttcatgtctaagacaccaaaagcaatggtaacaaaagccaaaattgacaaatggtatctaattaaactaaagagcttctgcacagcaagaaactaccatcagagtgaacaggcaacctacagaatgggagaaaatttttgctatctactcatctgacaaagggctaatattcagaatctacaatgaacccaaacaaatttacaagaaaaaaataaccccatcaaaaagttggcgaaggatatgaacagacacttctcaaaagaagacatttatgcagccaaaagacacatgaaaaaatgctcatcatcactggccatcagagaaatgcaaatcaaaaccacaatgagatacaatctcacaccagttagaatggtgatcattaaaaagtcaggaaacaacaggtgctggagaggatgtggagaaataggaacacttttacactgttggtgggactgtaaactagttcgaccattgtggaagtcagtgtggcgattcctcagggatctagaactagaaataccatttgacccagccgtcccattactgggtatatacccaaaggattataaaacatgctgcaataaagacacatgcacacatatgtttattgtggcactattcacaatagcaaagacttggaaccaacccaaatgtccatcaacgatagactggattaagaaaatgtggcacatatacaccatggaatactaagcagccataaaaaatgatgcgttcatgtcctttgtagggacatggatgaactggaaaccattattctcagcaaactatcgcaaggacaaaaaaccaaacaccgcatgttctcactcataggtgggaactgaacaatgagaacacatggacgcaggaaggggaacatcacacactggggcctgttgtggggtggggggaggcgggagggatagcattaggagatatacctaacgttaaatgatgagttactgggtgcagcacaccaacatggcacatgtatacatatgtaacatacctgcatggtgtgcacatgtaccctaaatcttaaagtataataataaaaaaaaagaaattggctgattggcctttgattattatagtcatttattcattcatttaattttttttaaactaagagttacaatctaatgggaaaaataatctagcagcatacctaattgaaaatcctgccatgaatttgtactgtagcaagagcatgaaacctggtttttattttgaggtacttaaaatattagagtaaatgaaaacattttagcaactacttataattcctcaaaatatcagcatttgtaaacttttgcatctagcttacttaaattctttatgcaaattagcatccaattataattatcaatattacagtaattgaatatagtgatggtgtgcatagcagaactaacattgtaatcctttatgtagtttcttgagtctgttgaacagtacacatataaaatgtctttaacctacctggtgtcgagcatactgtgctgcccacagcagttcacagtaaccacaacccctgacttaaaaatatggagaaaacgctcttgacagacctctgttgttgtactttgtcaatgtagtttgtgatagtcttggctaatgtgttacaccttgatttacttcctatcctattaaattattcatatcatgccatatatgaacatgccaatctttaataaaatgagctgaaaattagcatttagagaaaaacaagttcaagaacaaatactccctggaaacatagtcttgagacagtcaacatgaaatccattattttccttttcattgaaggtaaaaatgtgggttgtgggttgttcatctgataatgcccctcacaaacatatgagatccacggatttctataccactaggtttcctgggaggtctacattagccccaaggcagctggccagcgtgagttgtacctgcattgtgagaagatcatctttattatgtgtttacagttgcctgactcagtatctgttcctaagcagacagtggactgcccacttgtaggctcacctaactaaagttgtctcttacatatctggctatggaaaatttaaatgatgatgtcccttacatggccctaaagcatgtaagatacctaaagtgtatatgatgtgtagaagatgcctaaagcacatgcctaacatgcttgggtgaaaatccaagctgttacaacttacttagaaaagaggtttactcatttttgtgatcaattaagtcaatcacaataggaatattaaatacgtattatatgctgaacatgacagtcattgctagtatgaatttagccagtattgacttctctgataatctcaaaacaaggttaaaatatgtataaacaatgatttgttctcttagatgaaaaatatttacaataagcagaaaaaagcaccattcttgaactatgattttgttaatttgtaacctattatatgtagtgtttttcttttttaatagaagcactttggccccgttgcttgcaagtagtgcatattgttgctaatacttttgttgttaacttacaattttgaaattaattaatttaaccacagggtgatatgagataagatgatcataaatgttctaattatgacaaattattgaaattttatttgtggtatttttatgattgttatgaatatttataactgagaagatgatatgttttatattcgaagggtatatatttttgtgtgtatatgaatttatttaaatcagtctcattatttaaactaatctatgtcttgttaattggccatttcacaggtcatagatagatagagatttgggaacaatttgtactctgattgttgctatcagtttcttttttttttcctgaaagactttgcttatgtatgtgatgccctttcatttgatgcacaaagttaatactagtatcaacttttacacccacattatggactagaattttgaattaacccaacaattgactgagtctacactgatactttttaaacattaaaattaaattaaaattacgatgttaacattacaaactcatttttatcatttcttgcacaactcactctggaagaaactaacattaacctcacactcaccccttattctattctcagtgccctccttggaccctatgactccttcccaaggtcagaactgattaaacactagtgctactaagagttttagctgagagatagactgatttgttatttgctaggtactttgaacagaaaggtattgcaacgctggagcttaagtgactatgtttgaattttgagtgggtgaagcaagaaaatatggtgttcagagagaatgaagtttggagtagacatgcagagagaagcagggaccaaagaccatacaatccagagagcgtagagggcagtgtttgcctggtgctaaaaatattttggttgttggttccagtctttttagatactcagctgttctttctcctcagtttatttcctatcaattcccttgagcgtcttaagcagcttctattctttcaactaaataactataaggatactcatcctcgctttatttggttagcatttgctaaatgtatctactcctattgtttaacttttaacacttatctctcaagatttttctggattctaaacaaacttgtttagataattcattaggagtttctgagtaggatgtgagtttcaatagtcatacaagataatgaataacaaatttggttaaagtaaaagaaagtaaaagacagaaattgtaatagatgttgcccatacctgatacagatttaaaaaactagatgaaggcatcatgaaccattaactaacaattgtgaagtattgagcaaataacctaccgtttttgaatctctctctctcactttttaatttgtaatagaggaattgtattagctgtctaaactatttcacagggaacttgtgaggatcaaatgaaataatatatatgaatgtgcttttcaagaaccctattactgttttgtaatgcaaaagggtgtaaacctacagatacttcagattcaaaaagaactaagtacttatagatctttagtctatacagatttcagatttgttggctgtgtcaccacttcagtatatctggataattctgagtaaggttcttccaggcagaagttagggtatggggtaaactttctaaaacactcagcaacctaagcacttggtgtaatttcatgcagtaaatatggaatgggaaattttaaagtggagcagattctttgaatcatggattgctctagaatctctaaagtcactttaaaataccgaggtttggcgatataagcatttggctgctctaaacatggttgctaggcaaatagctatcctgtggggatcccctgggaagtgaattgaccttaaaccatgagattggtgtactttttcagtggctcttgcattgtcaacgtacagaggagttgtgaaaagttgccattccttttctgtagcatcacactgaatattttacatgttgcataaactttagtggtgagcaaagtacctctttatttggacagagaaaattttatatttgcgtataattacatataaaaattatatccaagaaggccaggcgcggtggctcacgcctgtaatcccagcactttgggaggccgaggcgggcagatcacgaggtcaggagatcgagaccatcctggctaacatggtgaaaccctgtgtctgctaaaaatacaaaaaaactagccaggcttggtggtgggcacctgtagtcccagctactctggaggctgaggccagagaatggcgtgaattcagaaggcagagcttgcagtgagccgagattgcaccactgcactccagcctcggcgacagagtgagactccgtctcaaaaaaaaaaaaaaaaaaaaaaaaaaaaaaaaaaaaaaaaaattatatccaggaaattgtcaaaggacatgagatatatttttgtaaggtaaaaaagcataataatgaaaaatgtgagttttgtagttactctacttaggttcaaattctggctttttgttcaattaactgactgcatggtttgcttgcattgtttggccttactgaatctcatttccctcctctgtaaaatgatgtagtaataataccattatcatagtatatttgtaaaacttagagagaaaaatgcagatgaagcaaatattgcagtatttggacccaggtgctcagtaaatattagctaatgctataatttaataacaaatactttaaaataagacaaaatttttgtttgaaatgaaaagcagtgaaactgctggtgttgctataacatcattcactaacatcactgttttgtaatgaaaggtgcaaagtattaatccaggcatccaaatttattacaaatataaccttaaagctatgtgaaaaacttcaatataaacatttttcaacactatcagtctcttccaattttgtgaaatgttgacactgacacaaagattttgatggttatgtgattctttgccatgacaaacaacgtttttgtctgtttataatgcgctttaattagaagtataaaatcagagttaagaggatttttgaagaaattagtagcttcctaagcccaactgtatgaataagcttctaacggaaaccaaggacaggattattttcaggcttttagtcttaataaaaatgtgcagagaatttcaattctaatttatataagtaagtcagataaatcaatttatttacctggattttggcccgtcactttctatttgaaaatgaaaagaattaattttcatattctatgcatatttattaatcagtattttttacacttattgttactaccttgccatttattattaccaattaaataagtccaatcattttttaaactttttattttgaataattttatatgtatagaagacttagaaagatagcatagagtgttctcatatacccttcagccagtttttgttaatgttaacattttatgttaccatggtacgtttatcaaaatcaagaaattaatatagatacaatactattaactgaactacagacttcatttataatttcactggttttcattcatgtcttttgtttgttctaggagctaatccaaggtggcaccagttatgtcttcttggtttcctccagtctgacagtttatcagctttccttctttattatgaccttgacacttttgaagagtattgaccaggtattttgtataatgttcctcagtttaggttggtctgatttttttttttttcatgaccagactgagattgattatacattttggggaagaataacacagcagcgaagtgctctcctcatatcaaatcagtaatacatttgttcaacaacttcttactggtgatgttgatcttgatcacttggttaaagttaatatttttcctgtcatataatctatttcctagaattaagtaactagactcagcccatattcaaggggtttgggaatgattaagcttcaccttctggaaggaggagtataaaaagtttgcgagtgtaggctaatatcaccataataattaataaatatttcagagaagtaccaatacaatagttaaacagtacttttggagagatatgtaaatactcatttttcctaaaagtttcttccactaatcttagcatctgtcagaggattttgcttgcagcaattattgtgatgttctaatggttccttcatttctccacatttattatttgaaattggtttgtaaagaagagttctccatttccccagttgtttgcttatttatttatttatgtaattatttatatatatcagcatgggttcatgaatgattatttcaatctttggaatataatttaatactgtcattattttgttgctcaaagtgtttcatctttggcaattgggagctcttttaggttggctcctgtatcttttctggaatgacagttcctccaagctcatcctgaattttccctgccctcatccctatcattaaccatttctctgagggtacccggttcacttcattaaagcatagtatttgggaaagactatctgggcacagagcatgctcactgctatgggagtgtcactgactctaaagcctctatcctgtctgataggccgatttagtcaggaaatatttgtatgtaaaaaatccaaaaaaactttgcctgtgcctatatagatatatctatatttgtttgtctatttattaaaatgtttgagtatatactggtatatccagctcaaattcagcaccacagagtttattctagccttctgtattatttattgtaatttctttttctgacagtaggaactctgactcccattatctacaattcatttaactaatgagtcattgatttatttatatgcataccccagtatacatctaaaatggtttctgaataactaaactatactcttgtgagaatcaaatttgccattgggtacagtatttgtgtctaattttattttattttattttttatctttattacacttttattctcaaagaatatttcaccggatatagatttctggcttgattggtgttggttgcggtggttgtttttctttatttttttttattatactttaagttttagggtacatgtgcacaatgtgcaggtttgttatatatgtatacatgtgccatgttggtgtgcagcacccattaacttgtcatttaacattaggtatatctcctaatgctatccctcccttctccccccactccacaacaggccccggtgtgtgatgttccccttccggtgtccatgtgttttcattgttcaattcccacctatgagtgagaacatgtggtgtttggtttttcgtccttgcattagtttgctgagaatgatggtttccagcttcatccatgtccctgcaaaggacatgaactcatctatttatggctgcattgtattccatgtgtatatgtgccacatttacttaatccactctatcattgttggacatttaggttggttccaagtctttgctattgtgaatagtgccacaataaacatatgtgtgcatgtgtctttattgcagcatgatttgtaatcctttgggtatatacccagtaatgggattgctgggtcaaatggtatttctagttctagatccctgaggaatcgccacactgacttccacaatggttgaactagtttacagtcccaccaacagtgtaaaattgttcctatttctccacatcctctccagcacctgtagtttcctgactttttaaagattgccattctaactggtgtgagatgatatctcattgtggttttgatttgcatttctctgatggccagtgatgatgagcattttttcatgtgttttttggctgcataaatgtcttcttttgtgaagtgtctgttcatatccttcgcccacgttttgatggggttgttggtttttttcttgtaaatttgtttgggttcattgtagattctggatattagccccttgtcagatgagtagatagcaaaaattttctcccattctgtaggttgcctcttcactctgatggtagtttcttttgctgtgcagaagctctttagtttaatgagatcccatttgtcaattttggctttggttgccattgcttttggtgttttagacatgaagtccttgcccatgcctatgtcctgaatggcattgcctaggttttcttctagggtttttatggttttaggtctaacatttaagtcttcgatccatcttgaattaatttttgtataaggtgtaaggaagggatccagtttcagctttctacatatggctagccagttttcccagcaccattgattaaatagggaatcctttctacatttcttgtttttgtcaggtttgtcaaagatcagatagttgtagatatgcaacattatttctgagggctctgttctgttccattggtctatatctctgttttggtaccagtaccatgctgttttgtttactgtaggcttatagtatagtttgaagtcaggtagcatgatgcctccagctttgttcttttggcttaggattgacttggcaatgcgggctcttttttggttccatatgaactttaaagtagttttttcccaattctgtgaagaaagtcattggtagcttgatggggatggcattgaatctgtaaattaccttgggcagtatggccattttcacaatattgattcttcctatccatgagcatggaatgttcttccatttgtttgtatcctcttttatttccttgagcagtggtttgtagttctccttgaagatttccttcacatcccttataagttggattcctaggtattttattctctttgaagcaattgtgaatgggagttcactcatgatttggctctctgtttgtctattattggtgtataagaatgcttgtgatttttgcacattggttttgtatcctgagactttgctgaagttgcctatcagcttaaggagattttgggctgagacgatggggttttctagatatataatcatgtcatctgcaaacagagacaatttgacttcctcttttcctaattgaataccctttatttccttctcctgcctgattgccctgtccagaacttccaacactatgttgaataggagtgttgagagagggcatccctgtcttgtgccagttttctaattaaaaaaaaaaactttagccttaaaatacccagttaatacactgtttcccaaagttacatagatcagactattttccctcaccctcttcagtgagattttacacaatacatttgtaatacagttagattcattttttcatagtctgctttcaaaactagaaacaaatgggtttggatccccaaaatctagttaattgttaaaagttggcatatagtaacatttactctgtgtggtatacagttctttgggtcttgacagatgcataaagaaatgtatccatcaccacagtaacatgcagaacaattctatcaccctaaaacttcccgcatacagtgtttttatagtaggaatcttcccacaagccatgacaatcactaatttgtttcacgttcctatagtttttgtgcctttcccaaaatgttacatatatgggattgtataatacataaggtttggttatggtttcttctatttgaaagatgtatttaaaatttatccatgttgttgcatgaattcatagttcattctgttttattgctgagtagtgaattccattgcatggatgtatcacagggtttttacttagtcacttattaaaggacatcttggttatttccagtttgggacaattatgaaaaaactgctacaaatatttatgtagaggtttttgtgtcaatataaattttcaattcatttgggtaactgtttagtaatgaaattgtaagttgtatgataacggtttgtgtacctctctaagaaactgtcaaatggttttccagtgtggtcaaaccagtttgcattcctatcaggaatgaatgagaatccttgttgctccatatctttgtcagcacttaatatattggcctttaaatggttctaaatttcttttattttaaactgttgatagtctcaaaatgacactgaagcataactggtgtaatattatttgaaaatattctgttgcatgatactacataatacgtagcaaggtaaattattagtatgtttaaagttaagggaaaggtaactttcatattgttgtgtatcatttacagttttgcccagtttttaaatttttttggcgtgcattcctctcttttgaagtcaatgaatgattcataagaaaaaatataagatcctatttgcaatttttttgcttttgttgcaattgctttcagtgtttttgtcatgaaatctttgcctgtgcctatgtcctgaatagtattgtctagattttcttctagggtttttatagttttgggttttacatttaagtctttaatccatcttgagttaatttttgtatatgatgtaaggaaggggtccagtttcaattttctgcatatgggtagccagttctcccagcaccatttattaaatagggaatccattcctcattgcttgtttttgtcaggtttgtgaaagatcagatggttctaggtgtgtggtcttacttttgagttctctattctgttccactgatctatgtgtctgtttttgtaccagtaccatgctgttttggttactgtagacgtgtagtatagtttgaaggtgggtagtatgatgtctccagctttgttccttttgcttaggattgtcttggatatactggcccttttttttgtttcatataaattttaaaatagttttttctaattttgtgaagactgttaatggtattttaatgggaatagcattgaattactttgggcagtgtggccattttcacaatatttattcttcgtatctatgagcatggaatattttttcatttgtttgtgtcgtttctgatttccttgagcagtagtttgtagttctccttgaagaggtccttcacatcccttgttagctgtattcctagatattttattctttttgtggcaattgtgaatgggagttcattcatgatttggctctctgtgtgcctgttggtgtacagcaatgttagtgatttttgcacattgatttttttttttatgctgagattttgctgaagttgcttatcagcttaagaagattttgggcttagatgatgggattttctagatataggatcaggtcacctgcaaacaaagataatttgtcttcctgtcttcctacttgaatacacttttttctttctcttgcctgattgccctggccagaacttccaatactatgtggaataggagtggtgagagaggacatcatggtcttgggcttgtattcaagaggaaagcttacagcttttgcccattcagtatgatattgaatatgggtttgtcataaatagctcctattattttgaggtatgttccttcaatacatggtttattgagagtttttaacatgaagggatgttgaattttattgatggtcttttctggatctattgagattatcatgcagtgtttgtctttagttctgtttatgtgacgaattacatgtattgacttgcatatgtcgaaccaaccttgcattgtggggatgaattgaacttgatcgtggtggataagctttttgatgtgcttctggatttggtttgccagtatttttcacattcattttcatcagggatattggcctgaagggtttttttgctgttgttgtatcaaagtgaacagaaaacctacagaaagggagaaaatttttgcaatctatccatctgacaaaggtctaatatccagtgtctacaaggaacttaaagaaatttacaagaaaaaagcaaacaaccacattaaaaagtgggcaaaggacatgaacagacacttctcaaaagaagacattcatgcagccaacaaacacatgaagtaaagctcaacatcactgatcattagagaaatgccaatcaaaaccacaatgagatacaatctcataccaatcagaatagcaattattaaaaagtaaagaaacaacagacactggtgaggttgtggagaaacaggaacacttatacactgttgctgggaatgtaaattagttcaaccattgtggaagagtgtggcaattcctcaaagatctagaaatatggttataagatagaaataccttaatatacaggtgatataagataaaatatggttgtaagatagaaataccatttgacccagcaatcccattacagggtataaatcatcctattataaagatacagtacatgcatatgtatgttcaatgcagcactattcacaatagcaaagagatggaatcaacccatattgcccatcaatgatagactggataaagaaaatgtggtacatactcaccatagaatactatatagccataaaaagaaatgagattatgtcctttgtggggacatggatgaagctggaagccgtcatcctcagcaaactaacgcaggaacagaaaaccaaacactacatgttttcacttataagtgggagctgaatgatgagaacatatgggacacatggcagggaacaacacatactgggacctgttggggggtggtggtggagggagagagaccatcaggaagaataggtaatggatgctgggcttaatacctaggtgatgggttgatccttgcagcaaatcactatggcacatgttgacctgtgtagtgtaacaaacctgcacatcctgcacatgtaccccggagcttaaaataaaattgatggaaaaaaaataaatatgcatttttaattttggaattacatacgttaaaatgctaagataataacagctccacataaaatatagaaaactttcaccaaatttacaaacatttttgaaaaacaagattactacttgtttttgtgtagtcataaagaaatcattgggattttaaaatattgatttattgtatgacaataagtttatacagattatagcaaatataagaaaaggtacttagtaaaaacacaatagaagtactgagaaaaaattgagttaatctctgaacatatgcccccttttataacctaaacctaaacctcagaaactcctggaacattacagaatatacagtcatactttccattagctatcagagtgatgatatcatcacacatcatgtaacctctggaaaactgtaccagacactcattagagaataagagtgaaaaagacaaacagcattttagtttattttaaaaatagtcgtgtacgcactgacagagtgttgatgacccctaatactgtgagaactgctctattaggctatgaacaggcactgacaaactggattgaaaaagaagtatagggaagcataatgaaaagttcagatacttgagagttttagtaatggaactttaccaaagcgaggtatttacttgagagagcatcttagtcttttagtaaataattgagtggcaaggtcaaaaccaccttatatacatttagtaattttttgctgatatagtacatgaacatcttgataaatatttaatattaaaatatggttataagatagaatcttgtaatcaatgacccagaaagccatttaatccatcatctaataaagagcatatcaatagtgaaagggcactactaattataatgctgagtcaatcagtgtaacacaggtttgtcccaggggataaaagttcaccttatcttgcaaatacatattctgagagcttagtagatttctaaatttgtgaatacttctgtggcttgtgcatttctcacataagtcagtaaagttcagattcctgagagttactaaaggtttgaatgataaatagcaacagttgatgagatatgaatgctgaaattttggctagttcattcagtaactaagtaactcatttctgtacatcatcttcaacataattaaatctattttatacacaatgaagttgaaaaagcatcatctagtcctaaattatgtatgattacaatgagtatgttctcctgactctatattggtttcacaccaacgatcactgacatgaaaaacagccacacaccctttataaaaacaaaaggctaattgagaatgaatctttagctcatcacttgttattcatgttagtttcttgcttgtatatacatgtgttgtattcaacacaaatattgtggatagctttgtactatgtacaaattttaagactatatctgtgtaagaatgtatttggtgacagagatggccaagttaaaaaagaaaatttgatagtaaaaaaaaaccttgatactttttatctcttttttttactagtggctaagagggcaggaatcctcatcatacacacaaaaggcaggtaaattaagaaacacaaagcaatggtctcaaacctgccactgccttgttatggaacttctgagctatctcattcacctttccttcaggtgacaaagaatggattatgggaatattgaactactccacaaaatctattgaaaggaataatcaatataaattattacaaagtagtttctcttttataccctccctgggtctccattatccaatttccaggttgtctggcatcttccctttgtcttctttgtcatgctgcttatctttttaggaatttctcactgaaatcatattttaaatggagaaagagagaattggttactctcttattgcttttattcttcagtcctcttaatacccaacatttatttaaaaatatttaactgtttaaaaaagacaatagcccttttttcttatcttcctgaaatactgcattttctagcaatgcttctccaaagctccactcacaaacctgcaacaaccttccataacacaagtttacctacataacaaatccgcacatgtaccccaaacttaaaataaaaatcataaaaaaggcaaaacaaaacaaaacgaaaacaataacgcactttgtttaattaagctttatatcagggagcggtgagctcaaaaggcacgttaaatcatgacctgtcatatctgaattattttgagtgtcacatttaaagcctttaaaaaaaggctctagctttttctgtgcgtgattgtaaaaaagtaatcatctgtgatagatgactatttgcatcaatatgtgctccttaaatctttcctgtaaagttccattaagttagcttaatctctacagcttgattgaatctttggagcttcagtcttcttatgtagtgttattccattcatttttgttattgcttttcctctaaccttctaaaggtgtgatctttgggagacattatctttacaatgaggaaaggtaccttgatggttagcatgtgaactctggatctagactgcctatattcaaattaaaccttgtcaggttctaacctgagctggggtctgagaggaattgggggatgggtggcaggtagccgaaagaactcttgagggattgtagaaagttgggacatgggccgggcgcagttgctcacgcctgtaatcccagcactttgggaggccgagacgggtggatcatgaggtcaggagattgagaccatcctggctaacacggtgaaaccccgtctctactaaaaatacaaaaattagccgggcatggtggtgcgcgcctgtagtcccagctacgcgggaggctgaggcaggagaatggcgtgaacccgggaggcggagcttgcagtgagtcgagatcgcaccactgcactccagcctgggcgacagagcaaaactccgtctcaaaaaaaaaaaaaaaaaaagaaagttgggacatggctttattctctctctcctacagagtcagcagtgcagttatattattcacaggcaatagtagctcaaagccaggtaagagctcaaacaggttacattaaatggttacataatgcacagggttgtgcacctgtgctccaaacctgctgtgtcatattgtaccagatgtctacctcagcccactcctgactgaagcacagccattttcttacactccaccccctatgctgagggagttctcgtagtggggaaacatgcccgcagggcagaaccctggacccagaggccacagcagcaatacaggaagcaacacccatgactaatattcccgctatgctgcccattattattaggatccagcatgggccagagcccagagacccaccatatctgtagggattcatgagtaaggctctcaactgctttgatttccttgaaaagctgctgttatgttttgttgattgtcagggatgaaggtacaacactgtggtcccaaaagagcaaaggtgccaccttgggcagcagttaatatgtctagggccatacgggtctgcagtaccaccttcctggtttgatcaacctcatctgttaatagaacgaaggcaactcaggtgttattcaaggcttgagcattgtgctctgcaagggctgtaacttacatttctacagttatgacacctgctccagggatggttaatgctaaggggtagagccaccagggggcttgctggatttgcaaaaaccaggaacattgtcccttccagttatgtgagtgtctaggcaatgtggggataacagtggcaggcacataagggcactaggtaatgcatggggttgtgctcctgggctccaaacctgctgtgtcatactgtactggatgtctaccttggcctactcctgactgaagaacagccattttccttatagacctctttcacagggaaattatgagtattaaataagttaattcatgtaaaatgcttaaaattatgactgatatgaaataaagatttaatactgttagtagtggcagagatctaagttatcccaagttaccagtaggaaatctgtatacgtctgcaagcaactttagcccttgtctactcaaaagaaagaatttgactgagggacatgaagcagaaaacaagactgaggcaagtttcagagcatgagtggaagtttatttaaaaaggccttagaacaggaaagaaaggaaggtgcagttggaagagacccaagcaggcacatgaaggtttaagagagaaggtcaaatgtcccgttcaaccatgattcttggccttttataggttcacctctttcccgagattcttcccgtatgtgcagagccctctctacagttgggaagtgagcatgcgcagtgtgtttaggaagagtacatatgcccacctgaagctttcttccttttttccagttgtgggtacgtggaagataatattttgccgtttttatctcttaatgtgcatgcccagtaagtttcttctttctggggtctgcctttaataacactttaatgttaataggtgtggaccatcagaagattgtctctccccggttgctgaattatcattttctgagaggcagtgtgacaatttttaaaacatcacttgacatttctagtgggtggagggagagccctctcctgccctactcatgcctatctatctacctataacaataaaatgtattgagggcctaccatagtttagggtctgatagacactaggtgtatagctataaagatactatatgcttaagaactgagtttagaaggagaggtacacattgaaacaaatatagctgtctcttggtatccatgggcaattggtttcagcacccctcattgataccaaaatctgtgatgttcaagtgctttatataaaatggcacagtacttgcatataacctatatacatctttccatatacttaaatcatctttaattacttataatgcccaatataatgtaaatactatgtaaatagttgttatactgtattgtttagggaacagtgacaagaaaaagtctacgtgttcaatacagactcaaacattaattttttccccaaatattttcattttactgtgggttgaatccatgtttgtggaacccacagataaggagggctgactgtaagtgaaatagaacataatatgcattgtaataatattacacaggttatagaggtggcataaatctggaggttctgcaaagtcttcccagaggtgaagtattcaggctgatctggaactctggctggataatggagaagagcaatctgggcactgttaccactgggcaggtgagttctgtaatgctgttcctggagtcatttctccaggcctacccaggcactagttctcaaggtgtttcaataatttggaaaacccaatttattagattagtttttgcttaaattatctagagtagttttatatctttgcaatgaaaccctctattatctttctttcccacaagacttacaaaaattagaacccttgcttgacaactgtttgcttctaatcttagaaaactgtccactcctaatatacatgtaagatagataccatgcttatatttcttaaatgccacctatttttctgggtcatatttttaaaaatgtactttaaatattcactactatctatttgtacatttcaagtaattcaaccttacgaactccaacttgcttaaatgcaaaatatacacattaatatctatgatatatagttgctgtaaataaacaaaatactttttataaaaatgttttgaaaactgtaatatactacgtaaagttagacattaaaagttactctacgatcaaatcatagggatttgtttttcaataaatgaagcccataagtgagtgttctgaggtcagataattagcatttagaaacagatgcaaatgcaagtgtattaacctgtggtggggctaataaatgcctagtgacctaaatagggattaaatttacgtctctactatagtttcatttttctctgtatgctaatttgagaatgcatattaagaaaagcatcatggtgcagtgttttttttaatgatgtgaacttaggttaaatgccatcttaactctgccaagtgaagtgatgaggaaattatacagccatttaaagtcattaaaatattttgcatttgttttttggtcacttttaacattttattttgaattgctaaagtaattgccttgaattaggatgacttttttgcttttgtttctgatatgtcatttggctattttgtgatgtgaattttaaaaacatttttatggcctgagtgatatcttaaacctatttgggtagttcctttaagatcctaattgtttttggcattttgtgatggagtaatcaggactgtatttaagtcccttgctattgaatattgcaaataattttagggctgtaagtaccttaaagaactttcttagtaaatctaataagcagtaaatacaactaataattgagttcagtcttagattcagaaacatcagtgagatcaatatctttttatctcatttccaaaatttttattttttctcttcctttctctaatctaggtaaagacatatgcatcattattatctgtgttcactgtaatagaaaattacatgcaccaagaatcaacttttgatgaaactactattgtttcagctccctgtcaaaactctcgtgtttaatcccaaactaactcaaaatacttaactggttaaatgatgagttctattgaggaaaagagtcaaactacataaaatatttgaagagatttgttttaagccaaatatgaaagaccatggcctgtgacacagccttcaggagaccctcagaacatgtacccaaggtagtcagagcacagtttggttttatacattttagggagacatgagacatcaatcaagtacatttaagatataccttggttctgtcaaaaaaggtgaaacaatttgaagtattgcagggtgggagttgtgccgcaaatttaaggagacaacttcaggctaaacctgatttaacgtgacaaagaccagatatttccttttaatagaaacaatttccttaaaacatcaataaaacagagataaacaatcaccattttatctgctagtaaatgttagctgcacaaaaatacacttccaaatagctctaaaagtagcttaaggtaacaatttatttagtttttattgctgctgagcagttctattctaggctggtcttggctggtctcaggcttactcatgcatctgtgatcagcttgtgtgttgtgtgttggctagggctggctggtcatggatggcctcagtcccgtgtctggttattgcctgagatgaaagagaagcaattgggccacacatgtctccacgtgagttctaaatgcagaaatatggcatacaccattcttcttctaagcattagaaacaaaccaagttcttggcaagcctctgcttgtattgtgcttattaatgttacattgggtgaagcaagtcacatgaataatcaagattcaaaggctggataaacggactctctcctttgatgggaagggaagaattgatagtcatgttgcaatctatcttaacattattcaaaactctttttgaaaaatataattgctcttcaaatttctatcaagtggcatgcccaaactccatgatcaaagtatcagtaatcaagtagatgctgttagtggtaggaagtgttttcccatcaggttaagttaggagacttgtagagaggctgctgttaaaataagcacattaacacacacatcctgagtcataaaacttctttgtagaattttggtcataagttgagtttttgaaagttagtgtaagctagcccacccaacccactgaaaaagaaatcatgaatttgcctcttgaattgcattttcttctaggagagaggtatgcctaaatcacatgttatagtggaatatagagctctttctctaatatataatataattaaattatagagctctttctcgtatatatttactcagtctttctgtaacaattcttgagatattacattataggtttaagttgaaaattaataccattccaaattgttctagtgcatgtttgaacaaagtggtgataaaagcttcaacagttggtcgttttctctgcttgctttcttccaactgcctctgttactaccacaaaggcaagttttttatacatatgttatctgtgatctggtactagtcacagttgtaaaatgaatcatttttccctctcaaacttggcaatatctttttaaaaaataaataaaatgactttttgggctgggcatggtggcttatgcctgtaatcccagcacaccgggaggccgaggtaggtggattgcctgaggtcaagagttcgtgaccagcctggctaacatggtgaaatcccatttctactaaaaatacaaaaaatagctgggcgcggtggtgcatgcctgtagtcccagctactcgggaggctgaggcaggagaatcacttgaacctaagaggcggaggttgaagtgagccgagatcacaccactgccctccactccagcctgggttgcagaacaagactctgtctccaaaaagaaaaaaaaaaaaaaaaaaaggactttttgctgtaagatgaagttgttgcccatgtcaatatttctctgtagctaaaaactttcctagttgcccagaattaaaaaaatcccatttcttgggatgataatcatctgttcaccattcatctattaattaattaatcaataataagctgtgattatttcctctaagctaagtgcagtgaaggatagcaaaatgaaatggtatattcactggactcaagctgcttataatcctgttgtacataaaaggcataaatataaaaggtaagtgaaaaaccaaaaatagacaatatatagcaggcgactgcgctttacccatcaccttctttgttttactctgtctctctccagaatgacatggcggccatgccctcttcatgatctcttgttgtgatctatcactgggacagaaggaaggtaatcaatactttctttataaataacatatcattgaattctcacaacacctttgtgaggtagatgtgtattacaacatttacctcacaagtaaggaaaaataaacctggagtaattaagtaaacttctgtagaatacatgaatttagatacagatcttttaggatctcaagcctacaacttttacagattatcaagtcttcctaaaattttccatcaaaatactccagaggacaataccttactttttttttgagagattatggaagtatagcccaaagcagtcaaccatgagcccttttttattctaaatttacatctgagttttgttgtcagcattaccgcttcccctgttcacagggaatttctgcacttgttagtgagaaatgtccgttcagaaagaaaactaacttagccagagacccttccaatagtgtattgcatacttaaaaattgctaaaagagtagattttatatctactcaccacaaataaatgataagaatgtgaggcaattcatatgttaattagctcactatagctattaaagtatacatatttcaaaatatcatgtacaccattacgatataccaacattccttgacttacgatggcttgacctatatttttccactttacgatgatgtgaaagcaataaacattaagtagaaaccatattttgatttttgaataaaaatcctttctaataactttattagaaagtaggctatgtattagatgattttgcctaactgtagactaatgtaagtgtcccacgaatgtttaacctaggctaggttaagctatgatgtttggtaagctaggtttactaagtgcatgtttgacttacattattttcaacttacagtaggtttcttgggatgtatccccattataaatcaggaagcatatgtgtatacagtttttatttgtcgattaaaaacacaaataattttttaaaaaacacataaaacacgaatgaaaaaccccaaaaaccttgtacttcaagtcaggaaggtcagactctgattctgtttccatcataaatacctgtatgacagtgaaaacaacaagaaaaacaacagcaaaaaagaaatactatgcatgaccacaatagcacaaaagcaggagtggggtaaatgtccatttgtgtgtgtgtgcgtgtgtattttcactcgagtccgtgtgaagagaccagcaaacaggctttgtgtgagcaacatggctgtctatttcacctgggtgcaggcgggctgagtccaaaaagagagtcagcgaagggacatggggtggggccattttataggatttgggaaggtaatggaaaattacagtcaaagggggttgttctctggtgggcaggggcgggggtcacaaggtgctcagtcggggagcttctgagccaggagaaggaaattcacagggttaatcactcagctaaggtggggcaggaacaaatcacaatggtggaatgtcatctgttaaggcagggcagggcctttttacttcttttgtgattcttcagttacttcaggccatctgggcatatacatgcaagtcacaggggatgcgatggcttggcttgggctcagaggcccgacattcctgccttcttttattaataagaaaaataaaacaaaatagtgttgaagtgttggggcggcgaaaatttttgcaggtggtatggagagagaatgggcgatgtttctcaggggtgctttgagtgggattaggggcggtgtgggaacctagagtgggagagattaagctgaagaaagatcttgcggtaaggggtgatactgtggggttgttagaagaaacatttgtcgtatagaatgattggtgatggcctggatacggttttgtatgaattgaaaaactaaatggaataagagaaggagaaaaacaggtataaaaggtctaagaattgggaggacctaggacatctgattagagagtgcccaaggaggttcagcctagccttgccagcaaagattatttatttacttcaagagtttagagtggcagtttggggatagcaccaggagatatcagctgtgatggcttggagaaacagtgtaaaccggcagtgtaaacaagagcagggcatgtatgagtagttgagaatggtgaataggagtatgactagacagaagatagtagggatgacaagtttttttggggcacagtctaagttggtctggtgttgaatgagactggggcctaataaaaaggagcatctatacaggagcttaaatgggctgtatcctgtaacattctgaggacaggcctgaattctgagaagcgaaagtggtaaaagtattgtccagtcctttttaagttggtggctgagcttggtgaggtgtgtttttaaaagacctttagtccattctacttttcttgaagacggaggaccgtaaaggatgtaaaggtttcactgaatactaagggcctgaaaaactgcttggctgatttgactaataaaggctggtctgttatcagactgtatagaggtgggaaggctaaactgaggaattatgtctgacagaagggaagaaatgactgcggtggccttctcagaccctgtaggaaaggcctttacttattcagtgaaagtgtctattcagcctaagaggtattttagtttcctggctccggaatgttgagtaaagctaatttgccagtcctgggtgggggcaaatcctcaagcttgatgtgtagggaagggagggggcctgaataatccctgaggagtagtagaatagcagatggaacactgagaagttatttccttgaggatagatttccaggatggaaaggaaatgagaggttctgagaggcgggctagtggcttgtactacagcatagcctgcctttgcttgtgtgtggcgattaggcctggtggaactgccatcaataaatcaagcgtgatcagggtggggaacaggaaagaaggaaatatggggaaatggtgaatatcaggtggatcagagagatacagtcatgggggtcaggtgtggtatcaggaataatgtgagaggccttattgaagtccgggccaggaacaatggtaattgtaggacttaaagagtgagtacagctgaaggagccagggagcagaaagtatatgcatcaggtatgaggaagaaaatagattttgggagttatgagaaatgtagagagtgagttgagcatagtttgtgatttttagggcctctaacggtattaaagcagcggcagccgctgcacgcagacatgagggctaggctaaaacagtaaggtcaagttgtttggacagaaaggctacagggtgcggtcctggctcttgtgtaagaattctgactgcaccaactatgcctaggaaggaagggagttgttgttttgtagaaggtgctggggtttgagagatcagtctgacaagaatggcagggagagcatgtgtgtttttatgagaattatgccaagataggtaacagatgaggaagaaatttgggcttgattgaaataatgggggctgtctgtgaaggtttgcggcagtacagcctaggtaatttgctgagcttgatgggtgtcagggtcagtccaagtgaaagcgaagagaggctgggattaagggtgcaaaggaatagtaaagaaagcatgtttgagatctagaacagaataatgggttgtagaggcagggattgaggataggagagtatatggttttggcaccacggggtggataggcaaaacaatttggttgataaggcatagatcctgaactaagttgtaaggcttgtctggttttaggacaggtaaaatgggtgaattgtaaggagagtttataggctttaaaaggctgtgctgtagcaggccagtgataacaggctttaatctttttaaagcgtgctgtgggatgggatattggcgttgagtggggtaagggtgattaggttttaatgagatggtaaggggtgcatgatcggtcaccaaggagggagtagaggtatcttatacttgtgggttaagttggggagatacaagaggaggatgcaaaggaggctttggattgggaagaagggcggcaatgagatatagctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggccgtcaatacccacaacagttatggaggcaacggaaataggcccttaaaaagaaggtaatgtggagtgggtagcctccatattgattaagaaggggacgggcttaccttccactgtgagagttacctgaagctcggcgtccatgatggtctagggggcttccgaggcaatcgggcagtgtcagtcttcagccgctaagccgagaagatctgggaaggagtcagtcagagagccttgggccagagttccaggggctctgggagtggctgccaggtgagttgaacagtccgatttgcagtggggtcccacacagatgggacgtggcttaggaggaatcctgggctgccggcagtccttggcctggtggtcagatttctggcacttgtagcaagctcctgggggaggaggttctggaggaatgcctgactgctgcagttcaggggtttggaagttcttgtgtgctggagatgtggctgggctttgtctcacagtggaggcaaggaattgcaacttttttttattattgtacaccttgaaggtgaggttaattaagtcctgttgtggggtttgaggaccagattccaatttttggggttttatttaatgttaggagcagattgggtaataaaatgtatattgagaataagatggccttttgaccttttagggtctagggctgtgaagcgtctcagggttgctgccaaacgagccatgaactgggctgggtttttatatttgatgaaaaagagcctaaacacttctgatttggcataaagaaaaaggagcattaaccttgactatgcctttggctccagccacttttttaagagtaaattgctgggcaggtgggggagggctagtcacagaatgaaactgtaagcaggaccaggtgtgaggaggggaggtgataaaaagattgcagggtggaggagcggaggctgaggaagaattgggacgtagcttggcctggcaaggaggggagaggtcagatgggtctgtagaaaaggaagattagaaagactcagcgatgcttggggttgggactgaggggacaggcaggagggaaagaaggaagatttgggagaagttgcactgggcacagagactaggaagggactattgtgtaaaagaatgcctggatgtcaggcacctcagaccatttgcccattttacgaaaagaattatttagatcttgtaggatggaaaaattggaagtgccattttctggctatttggaactactgtcaagtttgtattggggtcaagtggcattgcagaagaaaataagatgcttagattttaggtcaggtgagagttgaagaggttttaaattcttaagaatataggctaaaggagaagaaggaggaatggtaggtggaaggttgcccatagtgaaggaggcaaacccagagaaaagagagcatagagacacggagggaaggggttcgggggttcttatcctccagaaaagtgggaaggggggttggggcacggaaataagggattggggcacagagataagaggttggggtgtggaaataagggattggggcacagagataagaggtcagggtgtggaaataagggattgggggttcttgcctcctagaaaagcaggacttgtcactaagggtgaaggagaaggggttgaggggtacttgcccctcccccagaaaagcagagaaggggtagagacacagagagaaggggttggggtacttgccccttccccagaaaagcaggacttgccactaagggtgaaggaccaaggcaggcgtccctgcgtggtctgacacctttgaaacatgggtgaataatcagagaggcgtccctgcagtgatttaacaccaagggaaggctgccttcccagtccgtgactggcgccggagttttgggtccacggataaaacgtgtctcctttgtctctaccagaaaatgaaaggaattgaaattaagagaagggagagattgaagtgtggcaccaagattgaaaggagaaagaggttgagggacagtgagggaagctggagaaaagagtaaaaagaggccgcttaccggatttgaaattggtgagatgtttcttgggctggttggtctgaggacctgaggttgtaggtggatctttctcacagagcaaagtgtaggaggacgggggattgatctcccaagggaggtcccccgatcctagtcacggcaccaaatttcactcgagtcagtgtgaagagaccagcaaacaggctttgtgtgagcaacatggctgtctatttcacctgggtgcaggcgggctgagtccgaaaagagagtcagcgaagggagataggggtggggccgttttataggatttgggaaggtaatggaaaattacagtcaaagggggttgttctctggtgggcaggggcgggggtcacaaggtgctcagtcggggagcttctgagccaggagaaggaaattcacagggttaatcactcagctaaggtggggcaggaacaaatcacaatggtggaatgtcatcagttaaggcggggcagggcgttttcacttcttttgtgattcttcagttacttcaggccatctgggcatatacatgcaagtcacaggggatgcgatggcttggcttgggttcagaggcctgacatgtatgtgtgtgtgtgtatgtgtgctttaaaatataaggctttattaagggtttaaactgtcaatttgagacaggattgaaattttaccatgaaggtcttaggatggcttgtgcaagcccacagagcaaataaaaaccacatacatcataaaaatcatctgaatgggacgccagaaaagtcacagttcagagtgttagtgatttgtaactcctgggtgcagagtagtgtacctaagggccctaatccctgtcctttgcaggtgttcaagtcagggagttcaggttccttgcaatcagatttttgcctcagtggttgtatctgcttcagcagtcatctgtgattgtcaagttgaaattttgctcttcctcagccatcagaagtgcctggtttcatcaccaaattcagctttggggtaaatgaaattaagataagatctctttgttctctagaaatactacattaataagtcaaggatgaatattgtaatttttaggctaaccattaaaagaactgatgataaccatatatattacaagctaatggacaattaacttagtgggtgaaatgtaattgcaagggtcctgtacagtatgttcaatgatgattataaccctctcttctggaatgggagcaaaacaataattcactatcattatagttgactcttgaacaatgtggaggttggggcaccaaccccttgcacagctaaaaattgatatatgacttttgactccctaaaaacataatcgctaatagcctactgttgaccagagctttattggtaacataaacaagcaattaacacgtattttgtatattgtacatactgtagatctgttgagcattttgctagaattcttagtaaaaaatagcaaaaaaaaaatgtttattctaaaaggttttttagatggagcttttaggattttctgtatgtaagattatgtcatctgcaaacagggcaatttaaattcttcctttccaatttggtcaccttttgtttctttttcttgtctaattgctctaggcaggtccttcagcattgtgctgaatagaaatggtgagagtgggaacccttgttttgttcttgatcttagaggaaaagctttcagcttttcttcattgagtatgatattagcccagggcttgtcaaaaatggcatttattattttgtggcccattccctctgtacctaatttattgagagttttttttaatcataaaataatgttgaagtttgtcaaataatttttttctgcatttattgagatgatcatatgttttttgtctttcattctgtcaattggtttaccacatttatttgtgatgctgaaccatccttccataccacttaatcatggtgtatgatcatttaagtatgctgctgaatttgctttgataatattttgttgagagtctttcacatttatgttcattagggattttggcctgtaatttcttttattgcggcatcttaatctggttttgatattcaggatacaaaattaatataaaaaatcagttgcatagctatacactaacaaagaactatttgaaaaagaagttaagaaaatgatcttatttacaaacacaagaaaaagaataaaatacttaaaagtaaatttggtgaaggagctgaaaggtctgtacactaaaagctataagatattgatagaagaaattgaagaagacacaaataaatggaaatatatttaatcttcatgaataagaatagttaatattattaaaatgtccatattacccaaggtgatctacaaatcagtgcaattctcatcaatattccaatggcatttttcatagaaatagaaatacaatccttaaatccacatggaaccacaaaagattccaaatagccaaagcaatcttgtaaaagaagagtaaagctggaggcattacactcccaaatttcaaactatattactaagctatagtaatcaaaacagtatcgttctggcttaaaagcagatgcataaactaatggaacagaaagggcagctcagaaataaccccatgcatatatggtctactaatctttaacaagggtgccaaaagtccacaacaaagaaaggaaactctcttaaataaaggacacagaaaaatctgaattatcaacatgcaaaataataaaattgaacctttatcttatagcatatataaaaatcaaaatagataaaagatctaaatataagacctgaaaccaaaaaacttctagaatatgggaaaaaagccttctggcattggtcttattaatgattcttttaatataatacccaaaataaagttatcaaaagcaaaagtaaactagtgagactacatcaaaataacaagcttctgcatgacaaagaaaacaataaaataaaaaggcaacttacagaatgggagaaaatatttgcaaaccatgtatcttataagggattaatctccaaaatgtataaggaactcacacaactcaagaaaacaaccttataaaaaatcagcataggataaatgaacagacatttttccaaagtatacaaatggccaacaggtatacaaaaagatgctcaacataattaatcatcaaaaaaattaaaatgagaaatacaattagatatcattttacacctgttggatggctaatataaaaatgtcaggagataacaagtgttggcaaaggtgtggagaaaagggaagcttcatatatttgagtgggagtgcaaattagtacagctattatggaaagcagtatggaggttccttaaaaaattaaaaatagaactactgtatgatttagaaatcccgcttctgtgtttatatttaaaataaattaaatcagtatctggaagatatatctacaccctcatgtttattacagccctatctacaatagttaatatatggaaacaaccatagtgttaatcattgaatgtatggataaagaaaatgtggtatataccatgggatattattcagccataaaaaggaagaaaattctgctatttgtgacaatatagatgaacctgcaagacactgtgttaagtgaaattagccaggcacagaaaggcaaattttgaatgatttcacttatacttggaatctgtgaaagtctgacttgtagaaagagagagtggcatggtagttgtctgggcctggcaagtggggaaaaaggggagaagtttattaaaggtacaagcttttcattataagataattaagttttagggatctcttgtacaacatgagtactgatggatgcattaatttgattgggacaatcaatgcataatgtatatgtgtatgaaatcatcatgttgtacaacttcaatatacacaatctttatttgccaattagatattttaagataaataaataagacatggagaaagaaaaaaagcaagagaaaaatgaaatgttaaagaattggaaaggaagaaatgaaattgtcacaatttgcagatgactgatgctgtttgtagaataccctaaagaatctatggacatattttcagaacatatgagtgaagaagcaagtcatccagattcaagatgaacatacacacatcaattgtgtttctatataccagaagagataggataaaattaaaaattcatataaaatcaatatagcatctgaaatggagtattatgaataatttaattacttctacacagaaaacttatcagtcattattggggagaatagaaaacctaagtaaatggacatatatatagtggttgtgaattaaaaactcaatattgtttttaatgtcaactttgctcaaatttattcttacattcaatgcaatctcattcaaagttgatcagattttcttgttgagaatgcaaagctaattcaaaactttgtagaactcagaatagccaagacagtctttacgaggtaaaagaaaagagttggaagagtttcactaacacattagtactttactatacagttacagtaatcaagacattgtgataatgaaacacaaacaaacagaccaatgtaataaaatagcatccagaaaaacacctgcacatcttcatactgccacctgatttaaaacaaaatgccacttcaatacagtgggagaaaagctggtcttttaaataaattatgttcgagcaattaaatatgtgcaaaaaatgaattttgatacctatctcacattatacacagagattattttgtacagaatgtagatctacatgtcaaaagtaaaacaatgactattctaaaagaaatccaagaagaatatcttcatgggttttgggtaggcaattgtttatttggaggacactgtactaaccataaaggaaaagattggtaaattgtagtacattaaaattgagaactattgttcatcaaaagatatcactcaaatgtcagaaaattcaggtgacagagtggaagactatacttaaatgtatataactgataaagcattcatacttaaaaaatatatatataaatattctacatatcaattagaagaaaaaagtaatccaatttaaaaaaaatgagcaaaaatgttaagtgctcacaaaagaatagctccaaatggccaataaatatttaaaaggtgctcaactttgatcatcaaatgccataggtgtagtaagtgttttaaaaagtgagtaaccttgtacaataagtgttttaaaaggtgatccaccttaagcggcaatacttgttttaaaaggtgagcaactttaaaaggtgcttagctttggtcatcagtaaaatacaaatttaaacaacaatgtaattttttacacacctgataagatggctaacatagaaaattacagcaatacaaaggtaattgaagatgtggagccattggaatttcatatggtgttagtggaagtgtaaattattgcaaccacttttgaaaactggcaatacctactaaagctgaacatgcatatttcctacaactctatgacctatgcatctaaaacctagtataagactatttcatagcatcactgttggtaatagtccacattaaaaacacctcaattcccatcaaccatagataaaagtatggcatacacatacaatggagtactatatagcattaaactaacataaaaatttcaaatctcacacagaaaaggaagttcaaagcagttacttttaaatgttaaagtcttgagtccaatgttgaattttatttttggtgaaaagttggatttgacatactcttataacctaaaatcatcaagcactttctattgtcatatatgttatacattggggatagtgtaaaggggaataattttggagaaaaatgctcaatacctatttctgataaatgttttgtttaagtgttatacacaagtccatggagaaaatcatgtttcataataaaattatcttcttcttgttaacaaaagtttattagatacatgttactgaatgtaaatgggctaaatgccacaattaaaaggcacagagtagcaagctggataaaaaaccaatacccaattgtatgctgtcttccaaagacccatctcacatgcaatgacacctataggcttaaaataaagagatgaaggaaaatctccaaacaaatggagaacagaaaaaaacaggggtcacaatcctaatttcagaaaaaacaggctttaagccaacggagatcaaaaaggatacaaaagggcattacgtaatggtaaagggttcaattcaactggaagatctaactatcctaaatatatgtgcacccaacataggaacatccagattcataaagcaatttcttagagaccttcaaagagacttagactcccacacaatactagtgggagacttcaacaccccactgactagacagatcatcaaggcagaaaattaagaaagacattcaggaccttaactcagcactggatcaaatggacctgatagacacctataaaactctccactccaaaacaacagaatatacattcttcattcatcaatatacattcatcaccacatggcacatactctaaaactgaccacacaaccagacatagaacaatcctcagcaaataaaaaagaactaatataccaaccattcttttggaccacagtgcaataatattagaaatcaagactaagaaaattgctcaaaacgatacaattacatggaaattaaaaacctgctcctgaatgacttttggataaataatgaaattaaggcagaaattaagaagttccctgaaactaatgagaacaaagataaaacataccagaatctctgggacacagctaagacagtggtaagagggaaatttgtagcactaaatgcccacacctgaaagttagaaagatctcaatttaacaacctaacatcacaaataaaagaactagagaaccaacagcaaaccaatcccaaagttagcaggagaaaagaaataaccaaaatcagagctgaactgaaggagattaagatgtgaaaaaccattcaaaagatcaataaattcaggagttggtgtttgaataagataataaaataggccactagctagactaataaaaaagaaaagagttaaaatccaaataaacacaattagaaatgacaaagggtatattatcactgaccacacagaaatataactgtcagagactactattttccaaaaatgtaaaatgtatagcatttgtataacagctcaaaagtgtaaggcaagttaaattctgtttcagctgtttaaaattgcatattaagttgctttactgtgattccaagcaccttgacatgagaaatggtactatgactttcgtatatttctacacacttgtagtgagccttaagcctagtttgagagatatgctttaaaatagccaataagattacaacttagtcaaataagttgtgaagactttatctcttacatgcttcttatttatagattttttgtgctattatttaacaaatagattatgaactagatgctgaaaaggaagttatgcaatttctgttcaatctgttttttaaaaaaactgtctagcaattaaatgatctgagtgaattggagtttatgattctaattttacttttctgtgttgtctcctgatttttttgagaagccaactgaacggtttgatagtagtttatattattgtgtaggtagtatattctaggagatgtttagaaatttaaaactcattatatctagtttaattcctaatatctccacgaaatagctaatgggatttgaataatggcctgtataaatcatacatttatgctttaattattgcattactttaattcattcatttgttcttttagccattatatattattttcccattatgtgtctagcatggctgtagatactgagattgcagtggtgaataagccaatcaaggcattgactctccccagtttccagcctggtagagggcaaaaatatcaagtaaatgagtaagtaagtaaacagataacagatggcaataaatgtatgaagaagattaaaaggtgatatgatatagataaggacatatagctaagaggagctcttgttttaactgagatctgaatgatagtaattaactagccataacaagataagaagaagccccttttcaggcagaaaacacagctagtgtaaaaagccaaagacgaaaatcagtttatcctgttccagggaaacgagaagttgaatgtgcttgaaatgagtgggtaatgtgaagcataaggcaagataagttaaggaggcaggcagaattaaatgatttaagactttataagctagggaaagaattcatatcttaagcgtaatggaaaactactagagtttttaaaaatgtcttttatgtaaacagtgaattgttcacggtaaaagtaaaggctgagagttcagctagggtgtccctgtagcgattctgatgagagataacattaggtaaacatagaaggtaatgcagatggagagaagcagatagtttgggattatgtttttgaggcagagttgaaaaggctttcagactgattagatgtgggtaagagagaaaaataagaaagagaatttatctgcttaaacagcttattgaatgatagcaccatgtattaagatgcagatcagaggaaaaattagttttggggtgttatgaccacttcctattcatcccattggtgaaggaggaatctcgtgcccaaaattataggagatgttcaagcacacaacccctgacactggacagatgagatcatccagccacaacacactgcatgctgtgaagggccacacaggtgttgcactcaggagctgagtgaactgggctgtgggaggcaggctttgttagtaatgggagggtgagatgtcccctggttcctgcagaaggattggattgctttgcttgagtaattgtatgggttggccgggagattaaacctgttaggttgaggacagggtagaatgcaacagctgacggaagaactagctgggcagagaacatttcctactgagtaggggcatatctggtgacagcaagagaactcacagataggcctttcgggccctgtaaagttaaaaatgtcaaggcagcacttgaaagtttaggtcttaccctacgtcggggaaattaaggtccctttggccatgttacatttgagatgactgtaaagactgcatcgaagtggagacatcatgttgtatatgtaagtctgaaactgtgagacatcagaattggaggtaaagatttaggcgataaggacatttaacatcatgggactgagtagaagaatgtgtagatagagaagagaaaaggttgagctttagatgcgtttcaacattgagagttggagcagaggaaagggagcatcaaggagacttggaagagtagctattgaggtaggaagaaaaccaggaaggcgaagtgttatgagctgagagaagcattccaagaaggaagtgattatttctgacaaatgctgctgagttgtcatagaaggtaagtaatcatcagacctgcaacgtgataaccttgacaagagagtctctgtagagttgtgggaaattggatgttcttggtaggtacttatttatagttagttgaaactagtggtgtctgctggtctgtagcctctagttactgtttcctgttaatcgcactatgtaaaaaataatctatggaatcaaaggcaaattgataagctcagaattccatagaaaattggcctcatctccctttcacaagtcaatgtaagattttgtgagctgttttctatccaatagtgcaattgcttatggtcataggcaggagtataacaagcaccccatggccctgcctttctgtcatggcacactccatgattggttatactggggccctgctaacctactttattttcacaaacaagacaagctcccatctcagagcactggcacatacttttctctctgtctggaaacataatctcttttcttctggatgatctcaactttaggatcaccttaggtttcttcttaaatgtccctttcttaggaaagtcttcctggtctcataaattggcttatgtttccctgcaatgcactcttatcctgatttttccctttacaactcttgaacgcatctgcattccatgttcatataattatctgagtactatctcctttactcgactataaattctatgaagtcatcttctcaatatattttattcttcacggtatttctggtgcttggcacaagccctggtgtaaagggagtgaacaataaattataaaaataaaataataataaataccagagggtttttctttgagggaggtggcagacagtttattaattcttttttttcttcttttttattttatttttgttacagatgaaaacatttacttcagactgtttactactgttcgattctatttttcctttgattttctcttctcagtcataagtggaaatggaagggattcattcaaaggtagggataaggacaaaatccatttcaattaaaaaattaccttatgtataggataagattattgaaatggaaactattctgtttattagtattgcttaacttatttgcttctgtgctcaacttcactgtttaaaaaacctcatcgaacatcaaactgtaatatctacataaaaatagttttatttcaggaaagctacactagtttatatatagtttcatagtaaaattttatctacttttgttgttatttttgcactgcatatactttaaaatattaatgactaacaaacatgggaagatattttgttaatggaataatgcttcagagttctttttgtcattccgtggtcagtaattacttaccagcagtagacaatgttctgagacaggggattgtctacactccatacataatcttcatttcaactttgcccctcactctgaacttggtgtcactcagttcttgatctttatatctcccctccctgtacctcaagccctttatctctccactcatacttgacccttattgtttcccacatttccctctctgaactgaagtggtaagtctcagacatgaactgagcacattgctttaaaaattgtggtaataaaacaaagctgaatatttcatcaaaagccttcctgaaataaaaatgactgcattagtattgctgggccaaaatgttatgtactagcttgtgtatatagtagaaattaaaaaaaaatttttttcattgctaataatgattcaggaaacacactgcacaccaagtttgatctgacgtgttacagttaggaaaggctttgatcatttgtaatcagattagtgtccagtcaaatgactttgatggctggctgagagaatctgagaagaatgcgaggaagacatgagaatgtctttatttgtgtgaatctaaattgatattataaaaggtaactggctctgccttgcagaagaaatttttcagttggcattgtcaaatctcaagatagttttattggtgcctgatgatataccattagctttcttaacttcgaaagttatttagcagttagtggaaaaaaaattgtgtattacttaggcttccttgttcctgcatactctgttctctgtgcttgccttttttctcctcttcagataatttgtatttattctttaggattcagctcaagcatctctttgtgaaaattattccctgtttatctcttctttcctaccaattctttgacataggcagaggtcctctccccaacctgctctcatggcactctctctctctatatatattctttgataatttattatattgtagtgaaattatttgttcacaaatgtaactggaggttaacttgcattttgatggttcaacaagatagattcatcaaggatagatgcaatattaatcaagtctgtcaggcatagattagaatttttatccaaggaacaatatataaaaaataaataaatgaaaatgactatataataatacttattctttcataagttctcaaatttgtctttccatgtaggaagacaatatactagtcagtattctgatattttctccagtttctgggaactttgttaatattgcttaactatcttaatttggaatcaatactgggacaccctaaggcttagaataagaaccagaactggggttaattgatcatggtaaccaggcttcatacaatgtctaagcattcatctgatcagcctcttctctgaaaacactatgtgctttaaaacacatagaggtgggccaggtagtggctcacgcttgtaatcccagcactttgggaggccgaggcaggtggatcatgaggtcaggagattgagactatcctggctaacacggtgaaaccccgtctctactaaaaatacaaaaaattagctggacacggtggcgggcgcgttgtagtcccagctactcaggatgctgaggaaggagaatggcgtgaatccggaaggcagagcttgcagtgagccaagatcacgccactgcactccagcctgggtgacagagcaaggctccatctcaaaaacaaaacaaaacaacaacaaaaaaacacttataggtggtagttcatctacttcaaaactactacacgaaatgcataatgtctactctttaaagattaaaacatcagaacgcaaaacacttgtttgtttcctagggttattatgatagtcatagatggataaacatagcatttacttcaagttcatgtggctgcatctcagaaactattagttaaagccatgggtaggttctagagtcaaactacctggatgcaaagcttagtttcatgagtagcaaactgtagtttgggcaggatgcttaaaatttctgttctaatttcttcatttataagattgggataatactctagttcattaagttgtgtttaataagccatgtatgactttcaaaatactgactaaatgcttaagttggtaatatgaggtgtgaggctgattaaagataataaattatatttggcaaaataaatgttaacttttaacaactcttactaaactgaacatagttgttttgccttcttacacatattttctgttaaagacagataaaatagagctacagttctttcatgagagggccttcgcagtgaaacaaacatattagctcagcagtggaagactcctgggtactcttcagggatgagtcatgtggtgattgaaaatgtgcttgggctggaccagcagtttgctggcctagacctggcctattcagataatcagagtgggggaagtacagccagcaaagggcactatatcccttttcgttgaggaacagagcagctactaaggattctaccataaagacagtttagggtggcgttctagcaaagataaggatgcctacagcagttttgaatctcctaatgattcaagcactaagtctagcttcttcagagatcatggaagtggatcaaggggagggtttgataatcatggatggagtgattatgatggcactggcagccattgtgacagaagtggctttggcaaattagcatgtggtgaaaacagtcactggtgtgacaaataagatgaagatgattggtcaaaaccactcccaccaagtgaatgctggaacaggaactcttttctggaggcaacactgggattaattttgagaaatacgatgacattctagttgaggcaacagacagcaattgtcctccacatattgaaagtttcagtgatgttgagatgggagaaactatcatgggaaacatggaggttattatactagcctgactccagtgcaaaagcatgctgttactattagaaaagagaaaagagacttgatggcttgtgcccaaacagggtctggaaaactgcagcatttctcttgcccatgttgagtcagatgtattcagatggtccaaaggaggctttgagggccatgaaggaaaattaaaggtgagggcgcagcaaacagtacccaatcttcttggtattagccccaagaagagaattggcaatacagatcaatgagaaagcaagaaaattttcgtactgatctagagttcctccttgtgtgatttatggtggtgctgttattgttcagcagatttgagtcttagaaggtggatggcacttgctactagccactccaggatatctagtggatatgatggaaagaggaaagattggattaaacttttatgaatacttggtgttagaagaagctgatcagatgttggatatggggtttgagcctcagatacatagaaaagttgaacaagataccatgcctccaaagggtgtccaccaaactatgatgtttagtgctacttggcctaaggacatacagatgctcgctcatgatttcttcaatgaatatattaataccttattggctgtatggaggagttggctctacctctgagaacatcacaaagaaagttgtttgggtggaagaatcagacaaagttgtttctgcttgacctcctaatacatccacttgatcccaggcaagtacgcactaaccttaggtttatggagaccaaaaagggtttttattctctagaggatatcttataccatgaaggatagtcatgtaccagtatctatggacaccattctcagagggatagggaagaagctcttcaccagttaccctcaggaaaaagcccaatgctagtggctatagcagtagcagtaagaggactggacctttcaaatgtggaacatgttatcaattttgatttgccaagtgatattgaagaatatgtatatggcattggccatacaagatgtgtagaaaaccttggcctggccacctcgttctttaatgaggggaacataaatatcactaaggatttgttgcatcttcttgttgaagctaaacaagaagtgccatcttggttagaaaatatggcttatgaacaccactaccagggtagtaattgtggacgttctaagagtggcagatttagtggaggatttggtgccagaggctactgacaaaatagtggtgccagccgttccagtttcagcagcagccatgcaagcagcagacacagtggtgaaggtggccacggcagcagcagaagatttggtggaggtggctatggaggcttttgcaacactaatagatatggaggaaattataactcccagagagttgactggtgggtaactgagcctgctttgcagtaggtcatcctgccaaacaagctaatatggaaaccatatgtaacttagctggatgataccttgtgtagcttgaagaacttgcagtatattaccagctgtgattctccactaattttttcttttttaagggagctcaaggttccacaagaagaaaaaaagaacaattaacaaccttgtttggaaggtggtttgaagacttcattgccattgtttggattaattcccctcctgcctacctccaacccaaactgcatttataattttgtgactgaggatcatttgtttgttaatgttaactttagataactttttattttgatgtcctgttggctcaatacatcaattgttttgaaaaaattactgaacttgggctaaagtcaaaccttgggacacaggtgtgatacaacttaataggaaccatcgattcatccataaatattttaaggataaacctatttggtagcctccattagggctttttgatacttgaaaactgggggaaaacaaacaacaaatcttgtaaagtatattaatggaattagtttctactgctgcaaactgtattaagttaaagttctgattttctcactctgtcctggataggtatttgtaacctcacagcctttaaacaagccattccagtcacgatgaggtgatgtatgaatacatgcatacattcaaacactgtcttcaaagttaactcaagtaaatacagcaactcctctttcagtgtttaggcagattattaactatgagctagccaaatgtgggcatactattacagggaatgcttaaagatccggtaacttgaaataggtttttaggagaactcatctgcttagactttttaaatgcctgccataaatgaaattgaaatggtagatggggaccacagcaaagaccaaccctcgttagggccctggatgatttttggtctaataacacatgctagtgttgatgttttctggttaagagggtatgaacaggaagaattatgcagcaggctttactttaaatgctgattcacatgattgttcaagctgagttgagatgctaaactggcttactatagactttgtaaaaatggctccagaagagtaactaactgaaatctttaagctcacacaggttggaaatatgtacataattgcacaaggtgtcaatttactctacagcgcagttttagttgcataggtttccattgtatttatagtcaatttaagttaaatctggccaaagatgagcattgttcaccactaaaatgcctctgccactttgaattctgatctaattttgtggccagaatgtggtgattaaagcgctcagtctttttacagtggcataggaaaatggcaaaaatttcctaaagtgcagtagattttcaagtgtattgtgccttgttctagaacttttattaagtaggtacacttgacagtattgaggtcatttgtcatggtgctatttaattagtctaggtttaggcccttgtacttattgtccataatttgtacaaagtacttcttttattgcacattaagatatatatgcatatacgtcttctcttgtcttgtgtgcatgtccttaaacttccaatcttattttgtctcttggagattgttgaacacagcttgtctgggaaggggatgggactagatttctaaaatttatttgggaccattgggaagaaaactatttgcacacgacagatttctagatactttttgctgctagttttatgtaatatttattgaacattttgacaaatatttatttgtaagcctaaaagtgattctttgaaagtttaaagaaacttgactaaaagacagtacaaacacaatggcacttgaatgttgaatgtcaccatattcgtgaaattatatatttcagggtagtgtgagcttttaatgttaagtcatattaaactcttaagtcaaattaagcagacctggcattggcagtatagctataattttctgatattagtaaaaacaaaattgacaacttgaaattaaatcatgccaaggtattgatacacttgtcttaagatattaatgaaacacttcaccacactgatacgaagtgtccagattttcagatgtttgttgtgtgagttttgttgaattttatgtattttttttcagtgaatgtctggcacattgcaatcctcaaacgtgattatctttagttggcaatttagttggcataatcagtgacttgtacattcagtgatagcgtttgagcaagttttatcagcaggcagtattttcagttaataaataagatttcaaaatcatgtaaggttttaaacttgctgaatgtaaagattgcacctcaagtcactgtacctttagtaattgcttagtataatagttcagatgctagcaatgcatgtgctgtgaatattctgattttattaaaataaagttgaactacaaaaaatagataagatgcataaattgaacaatctctaagactacatggaaaggaaactcttgttcttggtataatattatggaccactgtgaatgttctatggactttgtattctatatatactcatattctctgaggatgatcataatggtagattgaaatatcacaatgatctcaaccccattcttagcaatgcaatttcatgtgatcatttaaaagtattagcaatgcacttatatagtgcttagatatttttagttgctttcactcttatctataaggggttgtccttaataatcatagtttacaagattatcatgtgaggtaggttgctatcatacaaggtagatgaactacattgtgtattgaaccatgaattccatggattttgacaggcataaaagataaatggctgatttgtgtttgtggaagttcattcaattcctgagaaaaatcaggaggtgaaatctaagaaatattaagccatcgagaggaggcagctatctttttgaaattaagatgggatgacaggtctttcagcctgagaacagctagcatgtgtactttagttgtcatgctcaaggtcaaaagaaatttcaaagtagttaaagaggttgcttgattgcctgcccgccgttcgttcgttctttctctttctttctttctttctctttctttctttctttctttctttctttctttctttctttctttctttctttctttcttttctttctttttctttctttctttctttctttccttccttcctttctttctttctccttcccttccttccctccttccttccttccttccttccttccttccttcctttctttctttctttctttctttttctttctttctatcttctttttggagtttcactcttgttgcccaggctggagtgcagtggtgtcatctcggctcaccacaacctctgcctcctgggttcaagtgattctcctgcttcagcctcccaggtagctgggattacaggtatgcgccaccacacctggctaattttgtacttttactagagatgggatttcttcatgttggtcaagctggtctcgaactcccagcctcaggtgatccacccgcctcggcctccaaaagtgctgggattacaggggtgagccactgcgcccggtctgattttatttcactatgaatttggagctctaagcctaaaagaaggtttctcataattcatggaaaaaggaggaaactttctctaaaatatttcttgtgtgcatatttacaaaacctaaacatagattttttttggaaatatttaaatatgctattttaaagagtttcatttttccatgtttatataaggcatgttaaaatagttgtacacctaagataatacagcagctttcagcatttaagtataagtgattgaatgttgatttatgaacattacagaccagaagattaataaaaatttttgcatagtgaaaaataattaggatttgacctcatttttatgcttatatccatataaggaatattttcacttattttatgtttaaatatccattatcagtaagggaagctaatgatatacatttttacatctacatatatctttgtgatgcacagccatttaaattcagatattgaaatacaccactgccaggagaggaaatgcacacaatacttaacctctagaactttgtcattgctatagaccagtgcctgctgtgtctttccattgttcccttttctgaatttgagtttgtaattatgtttatgttatgtatgttaccctttctccaccactgtatattagatgtacagcaggacagatgccttggcattttagatcgtagattatagaactacgagtagccccattaaggtcagatggagaagaccacacaccagctggatatctcaactttgaataggatgaagtaactggaagctatttgggaatgtcaaaaatgggatgtgacagggtatgttctgtgttgggcactaatggtgctcctagatatttggtagccaggtaggtaatctgtagcataaggctagattttcaccggttatgctgcctcccccacagtgctaagttgttgctgggaagtagctgcctagtcagggtctgtatttctctggatcccttgcaattaggtggtatcatatatccagtattgccagtggaaggcagttaggaattagatgtatcttttctaagacttctcttttctcatgccttgatgcaagaaaacacattgagagttggattttggcagtaccaaaaccacaagagggaaagagttcaattcattgactcatatcttggagaagaaccacatcctccaaaagcaaaaatcttattttggagcttagtgtgaaaaataaaccacttaaggtgttatacattttcagtatcatatatttaaatgattattactataactattgaaaaatatatgtttggcatttaaaagtcaatttcttaaaagtaactttcattttttggtggctttgaattggcagtgtagtttttgtctttaaatgaatggtgcatttgattttaaaattatttttcattttttattgaggtacttaaactgtcaactttagcgttttcctcacagatctgtgttttctgtactatcaccttgatctttaaattgaaattatttgttcttcatgttctttttaaagcttttaatgagcttgcagacaactatctctttgctgttcctactattaatattgcagatgcaaccctgggatagtgtaaaggtagggtaaaggcagagcactcacttgacaaggggtagcatgggatggataggatgggatggattagatgcaacacaaagcaatgaggtaaggtgagatggaataactgtgtagtagtaactcaaaagtatcacaaatttttggaccacattagcctggatgactattcttaagtaaagaaacaatgttgggaggctgaggcaggcgaatcacgagatcaggagatcgagaccatcctggctaacacggtgaaaccctgtctctactaaaaatacaaaaaaattagccaggcacggtggcgggcacctgtagtcccagctattcaggagtctgaggcagaagaatggcatgaacctgggaggcggagcttgcagtgagtggagattgcgccactgcactccagcctgggcgacagagaaaactccatctcattaaaaaaaacaaaaacaaaaacaaaaaaacaatgttattctggcttggctttggattaaaaggctttggctagggaatttacactctttgttttctctctttattgtgtaggcagagagagtttaattttagcccaattcttttattctttaataatgagccatattagtcaagatttgcattctagcacccattctttcaatatgtaaacaacttttaagtatgcaaaattttctttgagacgcctgggttctgccactaggacccaacattttgagttagtttttcttgcctaaagcccacatacttgcctaaagtccagcatcctcactgaaccaccactgggctgttccaccttgtttctccttccctatttcaggttctcagttacttcttgggtgctcagaatttgctgttaccatgattgcatatgctgaaatcaatgaattcagtcatgcatactgccaactctctccgctcattacgcttgcatatatgagaattcatggtgctctgctaaataaagggttatgtttgggggtcactgccttttaagagcacaaaactgaagctttaaatgttttagtgctttccacagcttagtgtttaaacacgtgctcagagatgaattcattaaaatgcactcatcctctcaggccacttaggattgcccacatgcatccattctcaggctatttgaaaacaggaggaagaggaaactcaacaatggatatttctagtacagaaaggatttatgattcagaacgtataacaatattctggtgactttgcattcatgcactactatccttttctataatctttccagtacattttagaataaactgtgggcttgctacaaactgagaagaacaaatcaatgaaaataaaagatataggtaatcaaaagaggtcttcaattttcctcctgaaaactcagacaaggtggaggctcaattcagttaggggaagattgggctgttcataattgcctatgtgacttgtcagttcctttttaattcgtacaaaacctttgtgagtgtgacattatatctagacgatagttatgttaatttccctaattgtgatattatctgcctatcaatagccacctattctaaactttaaaacatgtagcaatttttcatgcttgaaactcaaagtgacaataacgttggaaaaaaataaagacatttcctgtgaattcagttaaaatagaatgctcactttttccacagaataatgctttttaaaatttttattgcttatgcagtacatgcttattaaggaaaatatggttaacacaggaaaataaaaggaaaattgtaaactgtaattttactaaagacgtctacataacatttaggtacagtttcttttctcaaggcatctataaaagatatttgccattcttgttgaattctcagcatgtgtgtttgaggaatttccagcttatgaagcagatcttgcctctcattttagaagcagaaaacccaaggcttattttcagttggtcccatagctaagtgcaagcacattaacttcggctatcccaatttgatatgcacactctgggctttggattgagaattcttgaggcaaagcagcagagacacaggagaatgtattcccattggggtggagaggcagtagcatcaatatccaatttccagagggagaagaagcaacaatttcagtgttagcatcatttacatggttttggtgataaaacatttttgagtgacagtgactatgccctgcagttctggtggcagtgtagctactttaatggttctgaggtgtgatttatgtattgacagtgactaccaggccccacacttgttcttctagctctcaaagtttacaagtttcctaacatagtatcatgcctataatcttagaactctgggaggctgaggcaggaggatcacttgaggctaggagtttgagactagcctgggaaacataacaagaccctgtctctacaaaaaaattaaaaaaatgtatccaggtgtggtggcgtatgcttgtagtcccagctatttgggaggctgaggtgggaggatcactcaagcccaggaatttgaggctgcagtgagctatgatcacatcactacactcaagcctaggcaagagagtaaaccctcttgtaaacaaacacacaaacacaagtaaataaataaaaatttatttttactaagattatctgagttagtttatactgctcacaactaaaaacactgaatcagtggattattttttattatgtggttggaatcctatttatcatgtttcttagtctggggtgaattctacctagggaccggaattttctgaaggaaatttttatgtatggtttcagagttatgttcataattaaaggaaatattaataaaaaattccagttccatttgcaaagacagaaactgattcattattttgtaagttactttttaaggtttcttcaactattttgcttgctgatttgataattttcttccttagagttcctttaaaagacataggtcattgacttctgcttaataaaactcctatttttttaaaaaaaataggtttattgatatataatgtacacgtttaaatgttcaatccagtagtttttagtatatttacagagttgtgcagccaacccaataatctaattttaaaacattctcatcattccaaaaagaaattgtgtgcctcttcacagtcattatccttttacactccttcctctctcctttagcactaggcaaccaggcaactgcaaagctaatttctttctctttagatttacctactctttttatttcatagaattggaattacacagtatatcgtcttttgtggctggcttcttccacttagcataatggttttgagattagtctatgtcataatacatatcagtatttaatttcttattatggattgccaaataaaatttcattttattgcaattccatgttttatttatccattcatgagttgataggtagttaggttgctttcacttttttgctattataaataatgttgctatgaatgtctgtgtataagttgtgtgtgaatttatgctttcatttctcttggttagatacctaggagtagaacatctggggtcctatggtaactctgtgtttaacatattgagaaactgatgaagtgtttgccatggtggctgcaccattttacactcaattcaatttaatgtatccacattcaatgcattcggtttctccacattcttgccacagtatgttattgcctgtctttttgattatagctatcctagtaggcatgaagtggtatttcattgtggttttgatttccaattccctaattgagcaaataattatggaggctgaaaagtctcataatctgctatccacaagctggggaaccagataagacagtggtgtacagtagtcccctcttatttgtgatttcactttccatggtttctatatgtgtatgttataactaggtggttcatagtattgcgtatgttctctattttcttattaactatctctgtagatgttctgtccatcattgaaaggggagggtgttggagtcttcaagtattatattactgtagagctattgttctctttatttctgtcaatatatgttttatacattttggagctctgttgttaggtgcttttacatttacaattattatatcttcttgatgggttgagccttttagagttgtgtaatatccttcttggtcccttgaaatagtttttcacttgaggtctaatttgtctgttggtatagctaactcagttcttgtttagttactgtattacatgaaatatattttatcctatttgtagctctagatctaaagggagtttcttgtagaaagtgtgtagttggatcactgttttttttcattatgccagtttttgccttttggttggatagttttaatctgcttacatttaaagcagttactgagaagaaagggttatttcaatcattttgcaattgttttctgtaagcgttaggccatttttgtttctaatttcctcttttattgactccttttgtattcaatgtattttttgtagttaaaccattttgtgtcccctttcatttccttttttgtattattttttaaagatattttatttgcagttgcatggaaatactttaacatcttaagtttatgacaatctagttttaattgatatcaatttaacttcaatagcatagaaaattctctgctccaggacagttctgtccccacttgtatgttgttatcatcaattatatatttatacatcatgttcttaacaacagatcataattatttttatgcatttgtcttttaaattgtgttgtaaattaaaagtgaaattatgaatcaaaaatgcaactacaatacagtaacactggattttatatttgcccaggtagtcaccagagagctttatttcttcaatgacactgagttacggcctagtgtgcttcaatatcaaccttaaaaacatcctttagcattttgtatagggcaggcctactgataaaggactctcttggtttttgtttatttgagaacatcttaatttcttcctcattttttgaaggatagttatgatggattagaatatttttttccagcaccttaaataatatcatcccattgccttctggccttcataatttctgataagaaatcaattctttttttattttattttattttattattatactttaagttttagggtacatgtgcacaatgtgcaggtttgttacatatgtatacatgtgccatgttggtgtactgcacccattaactcgtcatttagcattaggtatatctcctaatgctatccctcccccctcccccgaccccacaacagtccccggagtgtgatgttccccttcctgtgtccaagtgttctcattgttcaattcccacctatgagtgagaacatgcagtgtttggttttttgtccttgcgatagtttgctgagaagtgtaagctctattagggtctggactcattaatagttattgaatgaattaatgagtttttaaaaataataaaataagctgaaaataaattttttattttcatattctcataaaatcatcattctcagaaatcaattcttttaaaatttattttcagattattatttttaaaaactcattcattcattcaataactattaatgagtccagaccctaatagagcttacactttaattggggaaatatacaataaatataatgaattattaaattatgtagtattctggaaggtgataaatgctatgaaacaataaacatcaggatggaggatagggaaaaattgtgcatgttgctgagggggagaagatatgcaattttaaataaggtaatcaggattggccttattggggaaagatttggtgaaatgaagaagtttgtcatgccactatcttggtggccagcattctatagagaaggaatagtcagtgtgggtcctgaggttgtagcatgtttagcaaagttacagaacaataaggaagctaatgtagatggatccgtgaatgctgatgagcacaggaaagaataggtgaaaggaggaaagttagaaaaggctacatcataaaagtgcttctaggccattgtaaaaattttggcttttcctttgagttaaatgggaaggcagtagagggttttgagtagaggggcaagatggtgtgatgcagttttaaaataatcattctggttactttattaagaatcaactgtataaaggaaacagtgtggacactattgtaataatgtttttgaacatttattttttttgtttggctctgccctacttatgctttagctcatttaattctcatatcagcactttgaagaaattgttatttttcccttcttcactgatgagttaagtgaagctcagagcagagaatcccttgcttgaagtcctctggtaaactgttggtgaagattggatgtaacccaagtctgttggttggacgatcccggttgtcacaactcaaaaattctatgcttcattactcagctacatgcacttttggccctcccttccaattcaccagctctctaagcagaattttttttatattttgagaattttgtccccataaattttttttctgaatcaataacaggaaaattagacatttctatgaggaaaaaatcaacaaggaagcacaatgtagtttttgaggaatggctgggtgagtgtgtttagaaaagagagaaccctccatgacatatattttactagccaataggaaagtagtaagacttcttttacttttaatattagttttaatgtttttaaagaaaaaatagaaattaaatctgtcacattatcacatatgcaaagggtgtaaatacattaaacatattcaatataattaccacaacttgaaaatactttattcactacaaactttatatacatttacttcttatataaacagatttttcatatatatatatatatgtatgaaaacacaaaactaatgaccttgtacagcccttctgaactttattctctattcctgcttggccctaagggaaattattccaaccttattgttctacatggtccatgtcattctggatttccttagcttttgacatattatcaatgataagtaggaaattgttactgttagaagtgtgagaaatgtttgtaagtctcctgcttttctatttgatgaaatagtttaccaggtactaatcataaatttttagaggaaattttgcatttgcaaaaactaaattcaaatgttgagctggccagcatttatttttcacatttattttgtatttcataggcttgataccaagcttcttggtattctttatgtgctttgtaagggcggggttcactctgaaattgctcagttcactgtttctaagacattggcaggatttggaaaaggacatgaattcagctgctgggtcagaaatgtcaccatcatgaagttagaagatggaataatgcaacagtgtgctgtacttggtaaaaaataaaaaagtgtgagagtgaattctgtaacaattatgtccgctttaatattttcccatacaggtaatttcaatatcttgtactttgtccagatgcaaaatagtaagcaatgtttatttttgatttaatgtattttgtttaaaagagaatacttacaatgatgtaagcctttttgattctttcatatttgtttaaaaatattttgaatttttctgatactgatctaagtaaaaaaacctgggctgttttaaccatctgcctagtagtctgagccagtgtttgccttcaaacaatggaaagattcatactgaactttagaaacagagggtagagtaaattttgaaggcagattctttccaagcttagcaaatatgaaaacactgggatgactttatttaaaaatgaatctcactgaatttgattttgtgcattattctgtaattcttattgtcaaaatgcagacaaaagagtgaaaaatcttctcttttatatttcactcttgttttattattgtcgtttaaatttttgaacttaaaaaattctgcctataggtctcagtttaagggccatgagtagtgagtgaatgatgccagtttttttctggaaagcattgaaaaaatactgtctgggtatttctgtcacactagaagggaggtgctcggtaagcaacacaacaatatgtatgttcacagaagccaaagcaaaccaacaatccaactgacgaggccagtatttttccttagaaataaatgtcttagaaaattctactgaatttctctaatatgtgagggccaggagttatatttttcaaatgtatgatactttggtagtggctgatgacattaaatttgagggctaaacttcatattcatattttacagctgaatatggttccatatgtctaaaacattaattaatgctagtaccatatcattcataaatttaagaaaataataactttttacatattaggctttttcttgacactttaacattgtatgataaatatatgttttaagaatgaacattcaaaaacattatattcaaacaattagatactatatattaaatttgcttatttaaaacatgcacacaagcttcacagactttattgagcatatggcaatgctgtaatgaccacttatcatttcagtatttgattttaattctttgaagttgttgcattcattaaatgattgaatgtgtaggcacatttgtatgtgtgtgtgtgtgtgtgtgtgtctctttgtttattggtatcatcagaagaaattcagctggaacacatatgtttagcttgtttagactccgaactttttgtaacaattggatatttctggttttggcttcaaaatagggaagagatttgagaaatagaccatgatttgccattgaatatttgcttttattctgttcttcaaaaatattttgttttaatatcggtggaggcacaacagtaaagtgtttgttagagagtattattttagacaaatatctttaaaaatcaaactgaagagtttaaaggagaagtttgtactacacattcacattctcaaaaagtttctgctttcttgagcaggattaacagtatccctaattcaaggaaagatgatctgtaagcactgaggcctggatgttactttttacacttaaaagtatttcttgttatgttatgagtctcagaaatgtgctagtatatatcttcttgtagtaaatgtgatgctttcttaggactattatctcatttctttctggtaagacttctgaataatctaagcaaatgaaagaaaaggtctttctgtggaaggatgtgtgttaaactcaccctcttgctcagctgttattagtttacatgtatccaaactattgtgcagattcgttttctaagaggtaattcacttgtctacaccttgcctagtttactcatatgtaacatatattggtatttttcaaccatatagtcttttgtcacacttgtgactttttttccctaaggagttgcctttgaagatattttctcctagtccttattctattttcagtgaggggagaggaagagaacataaatagtattcttcctctatttattggaatgtacctttactgttttataatctagctatttaaaaaatctgtgaaaaataaaaaatgataggaattttcttcatatttttagggtcttaactgactactttttagcttggtattcaaaaataagtaatggtcaaaaagtatataattttttaaaatttcactttctcagaaaaaaaatcaagagaatgaaatatacatttgcctaatgatttaactagatttccttttcagttaaatgccatggaagaaatctttaaatctttaaatctttacattctacaaaatgagttttcttgagcaaagattttcagttcctacttcttgaggttaattttccattactctagtgggaaaatgaatcatttaactttttttcccattttatatctctaggcaaaaaagcctattttatacagattttatacagattttgtttcccttcacttacaatattatgttttaaagattctttaatctcttggaaaaactatatatcattttaatgtcacaaatgtatattgcaatttgtaaatgagatagactggcgagtttacaagtattttcctgacatatttttgttcattgcatataataatttagagttttcaaagaataaatttaaagcccattttattttgggtggaggctaacatgttattagtgtctttgtcacatttatacactacctttctcaatttgaccatagctgcctaaaaattgctttctgtttctagagggtatataggacaggactggtaaataggagaatggggtcctagactggcaccatgatggtctcacactaatcttttacctcaggaaatggaattaagaatattcatccacagaggtatagggtgagcttatgaaacttgaagtggcggaggcagatttggaattcctgcgagagcagccattgaaacttgggtctcttggcgttgctcttttcttccgactggacctggtggtgtctgcatcgttggggtcaaacacgactgtcatggactccattctggtcacggtgtacatactgctttgccggtttggatgaaacctggtggtcttgagctctagctcatcatagctggaaactttgatgaaaggacaccagcgaaatgctctcttgaagccagctcgaaatctgaggaaaagcaggccacagaaagaaaaagttattttttcaagcagatatgtctttcagctgccacagaaaattctacctaaggcagttataacaactcagtttttgagtttggtttttagccagactcttagaatttatgtcacagtactgttgttagtcgtttagttcttgtttgaattgaatcttaatttcccattaatgagaagcattgattcccagcaatgaaaagcatctcattcccatcagtgagaagtcatcaatagcgaatgcatagcatcaggtaatcaatatgttaaagaaacagtacatttttctaaaataattgtatacatttacataaatataattgaattaggctggccagttaaggcacttaaaaatgatatatttcaaaatagtttctttcagaaatgattacacatttataaattaaagtctcgtttaatgttagaattgctaatcttgatgatttttatctaattatatatgaaagtgcaaaatccttaactttgtaaaccattaaatgaagttaattaaaagtggatgtaatgcttgtggggtgtcaggaattgagatatggcttatgcaattagtgaaaaaaaaagcaagagttaattaagtatttaacaaacttaaggcacagtgtggtagaaccccaactgagaagagagcttaggatttaattcatgcagttacttacataaagtcccaattctacttgtgaaaaaaacacattggtttattacaggacttacgagccctatgaaatttaaccctatcccttcatgtgctgaccagtacaaccaaggtgtttttatctggaaagcagattttatcttttttttctagtcttacatttgactacaaatattctcacttttcattttttaactttataaacatctttcccttgaccactgtgatttcttcacaagccatctccatagaggctgcatgctctcttactcaccccacctcacaatgcaggaaggaggattggagttcccattgtttttacaaaaccttctacttcaaagtttatttatttacaacatatcctttttaataaagtccgctcacatatgccatcatctctccatcttatagaaattattcaagaatttctaggaagtaacttcatttcattgaggatttgagcatattttcaattctcctttaatcatgagggcacttctttttctttggcaggtaaaattctgagattttggaggaagaagttggcccatagaagaatcatccagttagaaccccaagatcattatttggggcatctaattattaatgtgggatgctttataaagtgtgtatgggggtcttgaaagataaagcctgtgcctctctcagtgaattcttaaattttcccttccttctgcattttgaatttgaaccaagaaaatggaacaacattgtatgtttccagtgaaggtgggtgtgacaagcaacttgcatttcgtagttttgtttttaccttttattcagacagcagtagatgatgggattgtacatggttgagctcattgccagccaaaagctagccaggtagacctgctggatgtatttccatctatttagttgttgatagattgcagtgagaatgaagtaaatatgatagggcagccagcagatagcaaatgtcatgacaacaataatcatcattttgacaacctataaagaaaaaaagtcatttttgacaaatataatactcataatagttccaatagcttattgcaaatcatgcttttctgccaatacagttaaatacacatcatgcctagggaatagtcaatatattaaaaaatggtgaagcaatatacggacagttgcctaaggtaagtctcaagaaattatgctatgtcactattcatttctacctatctaagtgaatgggtagtgctaactcaaacacggacaaatatattttgattggcctgaagaaaatcagtgtttacaaaaacccagagagcctggaacagagagagataggaactaggatgtggctgtgtagcctgcattgtacgatagtggagatattatctccaggaaatcaactgttaagtcactatggaggtttactaggctgctagggctgggtttgttcaagtcagtactcttctatagcctgactatagcttaagactatttagatttctttaatagcctgctcactacgtaaccttatgaatattaatttggtttctcttataatctgatattggggaagatttccccaaatagtgattatgtgtaaatattcacgttagtgtgaggaaaatactaacttgagatttgcaaatagattattggtttatgcaactgttttatgcattagcttttatgactttggtaagcataagccatttcctttgattgtatacttgtgaatgataatatcctggacagctctaatcaaagtagaatgtcagctgttatttctcttccactaggcctaaaattcctgaagacagaatgtcttaattatctttttactcccagcatctatcacagtccttgatatatagctggagataaatatatataggatgaatgaataataaatagcaatgtacaatgaacaatgttcatatctcttttgggaatttggaaatagtaaaaagtttaaaataagatactttaagctaaacaattttgaagcttacctgcagtcagattaaaacaaatcagggaaagctctgatgtaaagggcctatgaggcacctcagaactaggaagatacagtatttatgaaatggacttgtcatttgactgcaaattagggattcagatgaaggttggcaaggtttagtcaggagagacatgattttagaaataggcaaagcatgaaatggatcaatgtggaaggtaactcttccctaagggccaaatcactgtaccatccaggtggccagcattgagcagatggaaattggccatcagagttgaaaatccaggtcaacagctcacaaaatgtcatcactggccacatcacataatatcttttgattttcccagtgttctttaaattacattgctttcttctgaagaactgcttttgtatttctgcattttatttctcagatttcctattcataattcatatatttgtgaaaaacaaatgatttaatttacatttatgcaatattttacgtatttaacaattaattaattgtctttcaattgcgcattaggaaattgaggcaaaaacccaaagatctgaccactgtgattcatgtaactaagatctttcttgtctttttaccctctatttacagataaaaacatctgttgaatatcttgagtctagaaaataacattgaaaatatagtggttgaggaccaattcctcatcctgaagtttacaatgtaatgaaaaaaaggaaatgtataattttaataaaaatgcatgcattgaaatgtggtgagtatgaacatgtgcagataaaatttaaaataatatttatgagaatgtactagtttattgtaataaagaatgactcaatacatgcctactaactgtaggctcagaggatattagactaaatgaaattagtctactgatgttttcattgttgaatttgtgagcattctactattccttgaacagggtagttaagctccagccatagattattttccctggctcctccctctacctagaacactcttctaaccatgattcccagggcttaagtacctcacctccttcaagccgttgcacaattgtcattttttctttgagtgctattctgaccaattaatttaaaatcacagtctgcccttccagccctcccagaacctcttagcttgctctttctcttcagtttgttatgttttttctttattttgtgtctcctgatgctggactacaaaagagcaaggattttctgtttgttttgttcatttgtatatttcgggcacctagactggacttcatacataaagggtactcagaaattttttaaatgaacaggtgaaagtgactataaaacaaaagaaactgaaagacgcagacagttaagtaatgtctaagattttagtcagttattactagtatcatttggttttcatttaagatggacatgtgtatgtaaaataagcatggaatttactgctatttctgctttcaaggcaaacaaatttaaaaagagaatgagtccaaaaataacctttttttttttttgagacagagtctcactcttgtcacccaggctggagtgcagtggtgcgatcttggctcactgcaacctctgcctcccgggttcaagtaattcttctgcctcagcctcccaagtagctgggattacaggagcgtgccaccacgcctggctaatttttgtatttttagtagagacagggtgttaccatagtggccaggcttgtctcaaactcctgaccttgtagatccacccacctcggcctcccaaaattctgggattacaggtgtgagacactgcacccggcctaatataattattttcatggggcacatgaaagcattagatttcattctaagcaaatgttaagagcaagtaaaatatctttgagaatgttaacatatattgtatttgaatcttttatacagactgactacaaactccctatgcacaaaattgttttccgacaattgctgaaaacctactaaggctatcagtccttttagataaatttcaattttcatagtgcaaaaagttcagaaaaacatgcaaaaattaaaatgcatgtggaaaatggaacagagacttcagatagcttttaactcacatacagagggcctttagaacttcttgcgaaagatttataaacatattttaaaaattttaagaaaagcttaaaatactctacagaaatgtttataagtgaaacagctgctataatatattttctgtacttatttctatataatactgttaccttggcactctgcttacaaaatcttgtagtgttatttcagatgatgaactctctggactctagttttgatgtgaatgcaaacgtaggctcttgggtgggagaaattgtcttgctttgtgaaatgctgaaatcacaaaactgaaatcaccctcctgataaaatgccaaagaaaagagctctttgaagcatgaagcttgagcaatgatagatgtgcaggtgctatgagcagttaccactgtattgcatggctgaacaatggtactagtgcaggcaggctatgaactgttaaacagaaaaaagaatcaggtggtaaactttaagaaattcttgagatttttaggcaagatgacaatctgggacagagaaggttcaaatctctcatcgtgtcttaataatgttattaagtgggtagccacccattacccttggaaacttacaagcaggataaaggaggaaagtggggacatgtaatgtagcccttacaaagttacattgcctatttttagcagttaagaatctaactacgtaggcaggatggaactgcatgtcctcatatattagtgagaatgaactttggataccattccttcatgtatcaaaggggaaagatcttagatttttgtataccgtacagattagaactgaaatgcctacagttgttcttattcattacattaaattagtgtaggatggatgattttgaggtttgggttgtaaaagcaaaaattagtttaggaaattaactaaaatgctgacaactatttagaaaactctaggggtcatattcttttttttttaattttggcaatattatcttctaattattttatttttattattatactttaagttttagggtacatgtgcacaatgtgcaggttagttacatatgtatacatgtgccatgctggtgtgctgcacccactaactcatcatctagcattaggtatatctcccaatgctatccctcccccctccccccaccccacaacagtccccagagtgtgatgttccccttcctgtgtccatatgttctcattgttcaatacccacctatgagtgagaatatgtggtgtttggttttttgttcttgtgatagtttactgagaatgatgatttccaatttcatccatgtccctacaaaggacatgaactcatccttttttatggctgcatagtattccatggtgtatatgtgtcacgttttcttaatccagtctatcattgttggacatttggggtggttccaagtctttgctattgtgaatagtgccgcaataaacatacgtgtgcatgtgtctttatagcagcataatttataatcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgtttcctgactttttaaagattgccattctaactggtgtgagacgatatctcattgtggttttggtttgcatttgtctgttggtacaggattgattctttctaaatgcttggaataaaaatggtcagctaggtgtgacaaaaaacaaaacaaaacaaaactgcttgttttgattagaatcctttttttaaaattttattattattatactttaagttttagggtacatgtgcacaatgtgcaggtttgttacatatggatacatgtcccatgttggtctgctgcacccattaactcgtcatttacattaggtatatctcctaatgctatccctcccccgtccccctaccccacaagagtccccagtgtgtgatgttccccttcctgtgtccatgtgttctcattgttcaattcccacctgtgagtgagaacatgcagtttggttttttgtccttgcgatagtttgctgagaatgatggtttccagcttcatccatgtccctacaaaggacacgaactcatcattttttatggctgcatagtattccatggtgtatatgtgccacattttcttaatccagtctatcattgttggacatttgggttggttccaagtctttgctattgtgaatagtgccgcaataaacacatgtgtgcatgcgtctttatagcagcataatttataatcctttgggtatatacccagtaatgggaaggctgggtcaaatggtatttctagttctagttccctgaggaattgccacactgacttccacaatggttgaactagtttacagtcccaccaacagtgtaaaagtgttcctatttctccacatcctctccagcacctgttgtttcctgactttttaaagattgccattctaactggtgtgagatgatatctcattgtggttttggtttgcatttctctgttggtacaagattgattctttctaaatgcttggaataaaaatggtcagcttggtgtgacaaaaaacaaaacacaacaaaactgcttgttttgattagaatccttttttttaaattttattattattatactttaagttttagggtacaagtgcacaacgtgcaggtttgttacatatgtatacatgtgccatgttggtctgctgcacccattaactcgtcatttacattaggtacatctcctaatgctatccctcccccgtccccccaccccacaagagtccccagtgtgtgatgttccccttcctgtgtccatgtgttctcattgttcaattcccacctgtgagtgagaacatgcagtttggttttttgtccttgtaatagtttgctgagaatgatggtttccagtttcatccatgtccctacaaaggacatgaactcatcataatttatggctgcatagtattccatggtgtatatgtgccacattttcttaattcagtctattgtttttggacatttaagttggttccaagtctttgctattgtgaatagtgccgctataaacatacgtgtgcatgtgtctttataacagcatgatttataatcctttggggatatacccagtaatgggatggctaggtcaaatggtatttctagttctagatccctgaggaatcgccacaccgacttccacagtggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgagcattttttcatgtgtttttcggctgcataaatgtcttcttttgagaagtgtctgttcatatccttcgcccactttttgatgaggttgtttgtttttttcttgtaaatttgtttgagttcattttagattctggatattagccctttgtcagataagtaggttgcaaaaactttctcccattctgtaggttgcctgttcactctgatggtagtttcttttgctgtgcagaagctctttagattacttagatcccatttgtcaattttggcttttgttgccattgcttttggtgtgttagacatgaagtccttgcccatgcctatgtactgaatggtattgcctatgttttcttctagggtttttatggttttaggtctaacatgtaagtctttaatccatcttgaattgatttttatataaggtgtaaggaagggatccagtttcagctttctacatatggctagccagttttcccagcaccattgattaaatagggaatcctttccccatttcttgtttttgtcaggtttgtcaaagatcagatatttgtagatatgcggcattatttctgagggctctgttctgttccattggtctatatatctgtttgtgcaccagtaccatgctgttttggttactgtagccttgtagtatagtttgaagtcaggtagcatgatgcctccagctttgttcttttggcttaggactgacttggtgatgcaggctcttttttggttccatatgaactttaaagtagtttttcccagttctgtgaagaaagtcattggtagcttgatggggatggcattgaatctgtaaattaccttgggcagtatggccattttcacaatattgattcttcctacccatgaacatggaatgttcttccatttgtttgtatcctcttttatttcactgagcagtggtttgtagttctccttgaagagctccttcatatcccttgtaagttggattcctaggtattttattttctttgaagcaattgtgaatgggagttcactcatgatttggctctctgtttgtctgttattggtgtataagaatgcttgtggtttttgtacattgattttgtatcctgagactttgctgaagttgcttatcagcttgaggagattttgggctgagacaatggggttttctagatacacaatcatgtcatctgcaaacagagacaatttgacttcctcttttcctaattgaataccctttattcccttctcctgtctgattgccctggccagaacttccaacactatgttgaataggagtggtgagagagggcatccttgtcttgtgccagttttcaaaaggaatgcttccagtttttgcccattcagtatgatattggctgtgggtttgtcatagatagctcttattattttgagatacgtcccatcaatacctaatttattgagattttttagcatgaagtgctgttgaattttgtcaaaggccttttctgcatctattgagatagtcatgtgctttttgtcattggttctgtttatatgctggattagatttgttgatttgcgtatgtcgaaccagccttgcatcccagggatgaagcccccttgatcatggtggataaactttttgatgtgctgctggattcggtttgccagtattttattgaggatttttgcatcaatgttcatcaaggatattggtctaaaattctcttttttggttgtgtctctgctgggctttggtatcaggatgatgctggcctcataaaatgagttagggaggattccctctttttctattgattggaatagtttcagaaggaatggtatcagctcctctttgtaactctggtagaattcggctgtgaatccatctggtcctggactttttttggttggtaagctattgattattacctcaatttcacagcctgttattggtctattcagagattcaacttcttcctggtttagtcttgggagggtgtatgtgtcaaggaatttatccatttcttctagattttctagtttatttgcatagaggtatttatagtatcctctgatggtagtttgtattcctgtgggatcagtgttgatatcccctttatcattttttattgggtctatttgattcttctctcttttcttctttattagtcttgctagcagtctatcaatcaattttgttgctctcttcaaaaaaccagctcctggattcattaatcttttgaagggttttttgtgtctctatttccttcagttctgctctgatcttagttatttcttgccttctgctagcttttgaatgtgtttgatcttgcttttctagttcttttaattgtgatgttagggtgtcaattttagatctttcttgctttctcttgtgggcatttagtgctataaatttccctctgcacactgctttgaatgtgtcccagagattctggtatattgtgtctttgttctcattggtttcaaagaacatctttatttctgccttcatttcattatttacccagtagtcattcaggagccggttgttcattttccatgtagttgagcagttttgagtgagtttcttaatcctgagttctagtttgattgcactgtggtctgagagacagtttgttataatttctgttcttttacatttgctgaggagtgctttacttccaactatgtggtcagttttggagtaggtgtggtgtggtgctgaaaagaatgcatattttgttgatttggggtggagatttctgtaggtgtctatcaggtcagctttgtgcagagctgagttcaattcttgggtatctttgttaactttctctcgttgatctgtctaatgttgacagtgggatgttaaagtctcccattattattgtgtggagtctaagtctctttgttggtcgctaaggacttgctttatgaatctgggtgctcctgtattgggtgtatatatatttaggatagttagctcttcttgttgaattgatccctttaccattatgtaatggcctttttttgttttccatttgcttggtagattttcctccatccctttattttgagcctatgtgtgtctctgcatgtgagatgggtttcctgaatacagcacactgatgggtcttgacgctatccaatttgccagtctgagtcttttaattggagaatttagcccatttacatttaaagttaatattattttgtgtgaatttgatcctgtcattatgatgttagctggttattttgctcgatatttgatgcagtttcttcctagccttgatggtctttgcaatttggcatgtttttgcaatggctggtactggttgttcctttccatgtttagtgcttccttcaggagctcttttagggcaggcctggtggtgacaaaatctctcagcattagcttgtctgtagaggatattatttctccttcacttatgaagcttagtttggctggatatgaaattctgggatgaaaattcttttctttaaaaatgttgaatattggtctccactctcttctggcttgtagagtttctgctgagagatcaggtgttagtctgatgggcttccctttgtgggtaacctgacctttctctctggctgcgcttaacattttttccttcatttccactttggtgaatctgacaattatgtgtcttttagttgctattcttgaggagtatctttgtggtgttctctgtatatcctgagtttgaatgttggcctgctttgctagattggggaagttctcctagatagtatcctgcagagtgttttccaacttggttccaatctccccgtcactttcaggtacaccaatcagacgtagatttggtcttttcacatagtcccatatttcttggaggctttgttcatttctttttattcttttttctctaaacttctcttctcccttcatttcattcatttcatcttccatcactgataccctttcttccagttgatcgcatcggctactgaggcttctgcattcgtcacgtagctctcgtgccttggttttcagctccatcatgtcctttaaggacttctctgcattggttattctagttatccatttgtctaattttttttcaaagctttgaacttctttgccattggtttgaatttctcctgtagcttggagtagtttgattgtctgaagccttcttctctcaactcctctaagtcattctccatccagctgtgttccgttgctggtgaggagctgtgttcctttggaggaggagaggtgctctgctttttagagtttccagtttttctgctcttttttttttttcccatctttgtggttttatccacctttgatctttgatgatggtgacgtacagatgggtttttgatgtggatgtcctttctgtttgttagttttccttctaacagacaggaccctcagctgcaggtctgttggagtttgcctagaggtccactgcagaccctgtttgcctgggtatcagcagcagtggctgcagaacagcggatattggtgaaccgcagatgctgctgtctgatcgttcctgtggaagttttgtctcagaggagtaccaggccatgtgaggtgttagtccagccctactggagggtgcctcccatttaggctactcgggggtcagggagccacttaaggaggcagtctgcccattctcagatctcaagctgcatgctgggagcaccactactctcttcaaagctgtcagagagggacatttaagtctgcagaggttactgctgtctttttgtttgtctgtgccctacaccaagaggtggagcctacagaggcaggcaggcctccttgagctgtggtgggctctgcccagttcgagcttcctgtctgctttgtttacctaatcatacaactaactcagcaatggcaggtgcccctcccccagcctcgctgccaccttgcagtttgatctcggactgctgtgctagcaatgagcaagactccatgggcgtaggaccctcctagccatgtgcgggatataatctcctggtgtgccattttttaagcccattggaaaagcgaaatattagggtgggagtgacccgattttccaggtgctgcctgtcactgctttctttgactaggaaagggaattcccttaccccttgcacttcccgggtgaggttatgcctcgccctgctttggctcgtgcacggtgcgctgcacccactgtcttgcacctactgtctggcactccccagtgagatgaacccggtacctcagttggaaatgtagaaatcacccgtcttctgcgttgctcacgctgggcgaacttatccttttttatggcggcatagtattccatggtgtatatgtgccatattttctttatccagtctatcattgatgggcatttgggttggttccaagactttgctattgtgaacagtgctgcaataaacatacgtgtgcatgtgtctttatagtagaatgatttataatcctttgggtatatacccagtaatgggattgctgggtcaaatggaatttctggttctagatctttgaggaattgccacactgtcttctacaaaggttgaactaatttatattcccaccaacagtgtgaaagcattcctatttctccacatcctctccagcaactgttgtttcctgactttttaatgatcaccgaactacaaaccactgctcaaggaaataagagaagacacaaacggaaaaacattccatgctcatggataggaagaatcagtatcttgaaaatggccatactgcccaaagtaatttatagattcaatgctatccccatcaactaccattgactttcttcacagaattagaaaaaactattttaaatttcatatgggaccaaaaaggagcccatatctccaagacaatcctaagctaaaagaacaaagccggaggcatcaggctgcttgacttcaaattatactgcaaggctatagtaaccaaaacaccatggtactggtaccaaaacagatatacaaaccaatgcaacagaacagaggcctcagaaataacaccacacatctacaaccatctgatctttgacaaacctgacaaaaacaatcaatggggaaaggattccctatttaataaatggtgctgggaaaactggctagccatatgcagaaaactgaaactggatcccttccttacaccttatacaaaaattaattcaagatggattaaagaattaaacataagaccgaaaaccataaaaaccctagaagaaaacctaggcaacaccattcaggatgtagacatgagaaaagacttcatgattaaaacaccaaaagcaatggcaacaaaagccaaaattgacaaatgggatctaaattaaactaaagagcttctgcacagcaaaagaaactaccatgagtgaacaggcaacttatagaatgggagaatttttttgcaatgtatccatctgacaaagggctaatatccagaatctacaaagaatttaaacaaatttacaagaaaaaaaacaccaccatcaaaaagtgggcaaaggatatgaagagacacttctcaaaacaagacagttatgtggccaacaaacatatgaaagaaagctcatcatcactggtcattagagagataataattcttttttttttctttttattattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgtggtgtttggcttttttttgcgatagtttactgagaatgatgatttccaatttcatccatgtccctacaaaggacatgaactcatcattttttatggctgcatagtattccatggtgtatatgtgccacagtttcttaatccagtctatcattgttggacatttgggttggttccaagtctttgctattgtgaataatgcggcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaactgttcctatttctccacatcctctccagcacctgttgtttcctgactttttaatgattgccattctaactggtgtgagatagtatctcattgtggttttgatttgcatttctctgatggccagtgatgatgaacattttttcatgtgttttttggctgcataaatgtcttcttttgagaagtgtctgttcatgtccttcacccacttttcgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtctttggttgccatggcttttggtgttttagacatgaagtccttgcccatgcctatgtactgaatggtaatgcctaggttttcttctagggtttttatggttttaggtcgtacgtttaagtctttaatccatcttgaattaatttttgtataaggtgtaaggaagggatccagtttcagctttctacatatggctagccagttttcccagcaccattgattaaatagggaatcctttccccatttcttgtttttgtcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcagtggtagttggatggggatggcattgaatctgtaaattaccttgggcagtatggccattttcacaatattgattcttcctatccatgagcatggactgttcttccatttgtttgtatcctcttttatttcactgagcagtggtttgtagttctccttgaagagctccttcatatcccttgtaagttggattcctaggtattttattttctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctccggcctaattgccctgtccagaacttccaacactatgttgaataggagtgttgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttggcttcatccctgggatgcaaggctggttcaatatacgcaaatcaataaatgtaatccagcatataaacagagccaaggacaaaaaccacatgattatctcaagagataataattcttaattagacttagcaaatcatacttatcttttgtaacagatatgcggtattgttaagcatgtttttgtttcttttagtccatatcattgcctatgcattattcattttgtgcccctagaaattagcatagtttttgagttttgaattttgaaggtatcttttgacttttgaaggtatctgattttcagactcagtttatgaacatttgaattgcaggaagcattatgtatttatttttatcttaccagtgtttagtgttattatgctcataataagaattcaaaaatattatttaaaataaataaaacaaaaatacttttaaatattttatatttaaattaaaataatctttattgctcttagtttttgtctctagcaggctggatgtttggaaagaatagctatttgagccatgtgataatataggcttaagaaagaaatacagttgtttttgtgtacttaatctattgtatacttagattgaacatatagagaatattgacttcaaatatacattttagatgatatttaatgccatgggaatgaatgaaattactcagagaatagagagtgagaagtggtctagattaagccccaaataagtcagacattttgaagtcagtcagatagagacaaagggctggaaaggatatcaggaacaagcagtgtttggcaagaaaactgctataacgtggtcagaaacatcactacagggttttcctctcctttaggagggattgccagtcctgtagaatgttgctcaaagttttagtaagataagaaatgatcgtttccatggagactagtggttgaactgaaccagagtacctgtggtggaattgtgcagtcaaaatctaaatggaaaggtttaaagtgtgaatgaaatattattggatacatacctaaaagaaaataaatcattctatcaaaatgacacacgcactcatatgttcgttaccacgctattcacaatagcaaaggcatgggattaacctaggtgctcatcgataatagattggataaagaaaatgtggttcatatacaccatgggaaactacatagccataaaagtataaaatcatgtcctttgcagcaacatggatgcagctggaggccataatcctcaatgaattaaaaccgaaatagaaaacgagataccacttgttctcacttataagtggaagctaaacattaagcacgcatggacataaaagtaggaacaatagatactgtagactactagaggcaggagaaaggggagcataggtggaaaaactacctattgggtcctgtgctcactacctgggtgatagaatccagaccccaaatctcagcatcacactatatacccatgaaacaaatttgcacatgtaccccgtgaatctgaaataaaaaaagaattatggatgttttcattggttataatggagggacatagattggaagctgggtggaggatcaaaagataattttctaaaattaaacatactgaaaggtgtttgaatgctattggaataagcctataggtcgccaagtacaaccgaaggcttatgctttctaacagagtatgagcaaatggattctgcaaactttggggaggtggacatttcttcattgtaataaaaaggtatgattgtagagagtatatcaaatggatttgtaagtaagttacatggtcagaaatctaatttcatctattgtctcctagtttcttaataactagtgctcagtgtgcctacaaacaaggtagcacatagaacattctgaataaatatttgtaaaatcaataaattaatagagcctgaggcaatgtcattagctaaatagatgaggaattaatttgattagaaaacagtgtattcttccctaaatcatacatatttcatataaaattgaaagtgctcagaaattgggctgcctctagggtggccaaaaatatgaagtgtgtaatagggaactacacagtgtaatgaatatcatagcacaggcttcattatgctgtggaattattagtgataagctactaatagaaaaagatagatatttgttggccttattcactgcattctatttcaacagtggccacaaaattatttccatacacaaatgtttttgtaggatgtaatattgtgttagtgtgatttatttacaccctaaagcaaatataattcaaaatatatgttatagaagctcttgctgtcttccctcaatatcagcaatgcaaaaagaaagaaactgctttttattataagaaataactcaaaaaggagcaacataaaagtacatttggtcttttatttttatgttttattttgtttataattaacagataatggttgtacattatttgtggggtagtgtgtttcaatacatatataatgaaatgatcaaatcagggtaaacagaatacttatctcaaacatttgtcatttctttgtagtgagaacattcaaaatcctttcttttagctattttgaagtgtacaatacattattgttgactatagacaacctactgtgtaatagaacatggtaacttattcttcctatcgaactgtaaatttgtacctggtgaccaacctctccccatcccctctcctgccactctcctcagcctctggtaaccactattctactagtgattagtgagaagtaaccactcacttcttctataaggtaaactttgttagattctacatatgactgaaatcttgtggtgtttgttcctctgtggttggcttaacataatgtcctctaggttcatggaaactgttacaaatcataaaaaataattttttatgactaactagcattgtattgcgtatataaccatattttctttaaccatgcatctcttggtggacacttaggttgattccacttcttggctattgtgattagtgctgcaataaatataggagtgcaggtatctcttcaacatgctaatttcattgcttttgagtatgtaccttgtaatggaattgctggactatgtggtagttctgtttttaattttttgaggaacttccatgttattatccataaaggctgtactagtttacagtttgtccctccaatagtgtataagagttctttttcctgtgcacctttgccagcatttgttattttttgtctttttcataatagccattctaactgggatgagattatatctcattgtgattctaatttgtgtttctctaataattagtgatgttgagcattgtttttcatatacctgttagtcctttgtatgtcttcttttgggaaatgtctactcagatcctttatccatttttaaattttattattactattatttttgctattgagttgtttgagttccttatatagtctggatattaactacttgtcagaggcatagtttgcaaatattttctccaattctgtagattgtcccttcactctgttgattatttcctttgctgtacaaaagctttttagtttgtcatcatcttatttgcctatttttgcttttatttctcttgcttttgaggtcttattcaaaatatccttgtccagatcaatgtcataaagcatttccccataaatttgtctagtagtttcatagttttgggtcttacatttatatctttaatccattttgagttgatttttgtaagtgttgaaaaacagaggtctagttccatccatctgcatatgcataaccagttttcctagccccatttaggggcttgtcctttccccaatgtgtgttcttggtgcatttgttaaaaatcagtcgggtgtaaagtgtggatttatttctgggttctctaatctgttccatcggtatatgtgtctgtttttaggctagtatcatgctgctttcactatttttgtttttagtatattttaaggtcgggtagtgtaatgcctccagctttgtcctttttgttcaagcttgctttagctattcagggtcttttataatttcatgaaaattttaggattgtttttcctatttctgtgaacactttcattggtattctgatagggattgaattgaatttgtaaattgttttgggtagtatggatattttagcaatattaattcttccagtccaagaagatgggatatttttccacttattagtgtcctctttagttgcttttgttaatgtttcatagtttttattgtagagatcttccatctcctcggttaagtttagtcctagttactttatttttttgtagctattgtaagtgggattgatttcttaatttcttttttagagagtttgctgttggtgataattaataactaattaacaccttaaagagcaaaagtaaggtacacacagttgcctcctaaggcagagggggagtaaaatttgttggagaccttttatgtgcaaggctctgtgccacatgcattacctcttttgaactaatgcaatctgtacatattggaggtgccagctaattatgtttcaattatagttaaactgtctagtagacaagcatttccttttttttaacacagacatggcatcaagaagtagaggagaatgattctggagcaaaaggccaataaaaaagtttacttttttgcccctctaaaagctacattcttcttgtgaacatccacacctcagtaagtgtcatcatcatctatctgactgccagagacagacacttataagtcatggttgtttctttggttttcctcattttcactgccccattcaatcacttggcaaatcctattgaccaagacatcaaaataagtcttatatcttttaatatcttgtcatctctactactataacctctgagaaagcattgttgtctctctcctaaacaaatgcgataaccatctaattggcctctgcttccaaatagcagatacagtaactttttaaaaaatgtaaaatagattaccctctacttaaaataattttcttattgtatctgaaataaaactgaacattcaaagcttctgttatattttgctgccgtgttctccagtctcacccattacatactcccattggttctttatgccccaacatcctgacttctttctgatccttaaaaacatcaataattttcctacttcaggcattgcttatgttgtctttcttgcctggagtgctcttctcctaattctttgtgtgctttatttgttcttattgataagaactcagctagaatatcactccaacagtcatttcctaccaccctagttgaaaacaactccgattgcaattattctctttcatggcttatttccttcagcttttccagtgtaatttgttactctcttgtttatttaggggttatctttgccctgcttaaatgcaaatcccatgaagttcttttttttttttcttgtggttattttttgagacagcctcgctctgtcacccaggctggagtgcagtggcttgctcttggctcactgcaacctccgcctggttcaagtgattcttgtgccttagccttctgagtacctgggactacaggtgtgcaccaccacaccagctaatttttgtgttttttagtagagattgggatctcgccatgttggccaggttggtctcaaactcctgacctcaggtgatctgcccaccttggcctcccaaagtgctgggattacaggcgtgagccacagagcctggcctgggaagctgtgttttgcatttctctctctctccagtgcttagaagaatacccagagcacatgataaccctcttttaaataaatgaataaatgaatatataaatagatgaatggta

SEQ ID NO: 1719 - DNA, 28880 bp, Homo sapiens
aatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggc

SEQ ID NO: 1720 - DNA, 17857 bp, Homo sapiens
ctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaa

SEQ ID NO: 1721 - DNA, 16026 bp, Homo sapiens
gatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaa

SEQ ID NO: 1722 - DNA, 2901 bp, Homo sapiens
ctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtcccagaagcttagatgtgacatgggtgtcctccacccacattcctatcacttcttggtcactcgttttaatgtaggttttgcacaaacatccaagactcaggatggcccagctcccacagtccttgaaaggagctgtctgctggggacgtttcttaatttcttgctgtggttgaggggctgggtctggagatggctctaattgtgctgcttgagacagcttgggtcacagctttccccttcagaggccctttttgggaatgaatgcatctttggaaactttaaaatgaggggggtgcattggttcactggcactgtgtagtaaagtgccacaggggagtggctcagacatcagagaattacatcctcaggcctttcgccttggcttgtagatgccggcttctccccgtgtcttcacatggtctcccctctgtgtgtctgtgtcctcaccgcctcttttattttattttttatttttgtttttattttttgagacagagtctcgctctgtcaccaggctggagtgcagtggtgtgatctcagctcactgcaacctctgcctcccaggttcaagcgattctcctgcctcagcctcccaagtagctggcattacaggcaggtgccaccacacctggctaatttttgtatttttagtagagacggggtttcaccatgttggccaggatggtcttgatctcctgacctcatgatctgcctgcctcagcctcccaaagtgttgggattacaggcgtgagccactgtgcccagcctatttttttttttttttttgagacaagttctcactgtgtcacccaggagtaaagtggtgccatctcagctcactgcagccttgatctcccaggctcaattgatcctcccacctcagcctcccaagtagcggggaccacaagtgcacaccactaggcccatctaatttttgtattttttgtagagatggggtttcaccatgttgcccaggctgttctcaaacccctgggcttgagcgacccacccacctcagcctcccaaagtgctgggattataggcatgagcggacatgcccagcctgcacccctctttttagaagggctgcggtcctattggattagggcccacttatatgacctcatttaatcttgattacctccataaagaccctgtctccaaataccatcacatcagaggtgctggggttaggacttcagcatgtggatttgtggggggcataatttgccttgtaccgggaggatatgaagtgttcatgttactctccctgtagccctgagagcatctcccttagagtatcctataaaaggagtcgctgctcactcagttatgggttgttcaccccctcgctcaccccagctctgcagagaactggggatcccatcggccatgctttctgggctggcctctggtcgcagtcagtccctcgctgtggcgcccccccctcccccagctccttcccagggtgatgacccgctgaccccctggggtgcacctgctgcaaagcagcccccttccttggcatctctcagcattctccgtagtgagcctggcctttctgatcttgttagctttttgtcttcctgccgcagatcagagctttggagtaagttttgata

SEQ ID NO: 1723 - DNA, 3199 bp, Homo sapiens
aagtcagtgggaaataaattttggtatatggctccttttacttacatgcagaggaagttgtaccaattcagattacataatttctactgtgtataatcagtttccagtgcgaaaaggtttaaaattcatatcatatcaccagttctgtatgaatccttaaaatcttaatgggactctaaaaaacaccttacagcatagataagctgtaaacaacattgttctccattgattcatgttcctccttggagtaattccacaattttatgtatccaaaaggccaaaaagttaataagatgaataaagattaatatttattgatactctggtttaaacattctcaaactctatgaggtatataattttattacctatatcttagcaatgaagtaaccaaggtaagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaaccttttagttgaattatcaattcttgtgtgtgccaacattcaaatttaataaatgcattttattcatctatacgttctcactatttttctctatatggtatttgttacgtatccaaattttttttaaaaaaagcagggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaaaaaagaaagaacagtaaagaaggtctcatgtaaatgagaaatgttctctacaatattattttagggggctacaacagcctggcagggtgcttaccaggatatctcgatgcttagcacagtgacttgcccatagtgtagattaaaggtcccaacactaggcttccagtcccaacactgcatctaaatatatgaccttggccattctctggctttactttatttattaaatgagcactttggactaggtaatctctaaggtcatttccatttatttatttatttattttatttattttttatttttgtttttttgagagcttgtctcactctgttgcccaggctggagtgcagtggcacaaactcggctcactgcacctctgcctcctgggttcaagcaattctcctacctcagcctcctgagtagctgagattacaggcacctgccaccatgcctggctaattttctttgtattttagtagagacagggtttcactatgttcgtcaggctggtcttgaactcctgacttcaaatgatctgcctgccttggcctcccaaagtgctgggattacacgcgtgagccactgttcccggtggtcattttcatttctataattagatattatatgcttctaagtgacaagagactaaagacatttccgtactgacctttgtatgtaatcagctgacaccacaatttagaatgtcaaactatcctcatggtattgctgatttgattatggttagaggctgatgtgtctctagtgtgcatagttataattgacactgatgggtataaagcagttcacagggcttagaacagacaaaatttgaatcttctaggttcccttcaatgttcacataaactataaatcatcctaattttggaatctgacagcttcagtaaagccttctggatttcaaagtcatctgtgattccaaaaagagtctctgaatattataccagcctctgtgtaacattctgaaatcccagctctaaataaatcttattgggtgtttggtttaaaggtgaactcaagcaaacctattattgaaaatctggttcctggtgcccagtaccaggttgtaatatacctaaggaaaggccctttgattggaccaccttcagatcctgtgacatttgctattggtaagttgctagccacaagaagaatgactgacctatatattagggtattgacggaggggtgcaatgtgcgagctcaaatcattatcatcgtatttggaaggtccatattagttcatccaatatgctaccttcagagtaataaataacaagaattgtatacttggaaaacattcttaatatttattacttggggaaaaaatcagaggcaaacattcttactttagttttcaatgattatacaacaagagtaaagctgtgtgccgtggcacacacctacagttccagctacttgggaggctgaggtgggaggactgcttgagcccagaagttgtttgttttttttgttttgtttgtctggttttttttttgttttgtttttttttttttttggagacagagtctcgctctgtcacccaggttggaatgcagtggtgcaatctcagttccctgcaacttctgcctcccaggttcaagcaattctcctgcctcagcctcctgagcagctgggactacaggtacatgccaccatgcctggctaattttttgtatttttagtagagacggggtttcaccgtgttagccaggatggtctcgatctgacctcgtgatctgcccaccttggcttcccaaagtgctgggattacaggcatgagccaccacacccagccaagcccagaagttttaatctagccttggtaacatagcaagaccctgtctcaaaaaaaaaaaaagaaaagaaagaaaagaagaaagaaagaacgaacgaaagagagagagagagaaagaaagaaagagagaaaggagaaaaagtgagaaagagagtgagaaagaagagagtgagaaagagagagaaaaagaaaaagagagagaaaggaaagaaagaaaagaaagaaagaaagaaaaagaaaagaaaagatgaaaggagggagggagggaagaaggaagggggagggcagggggagggaggaaggaaggggaggaagcaagaaagggaggaaggaaggaaggaaggaaggaagggagggagggaggtaggtattgtatcagagagtga

SEQ ID NO: 1724 - DNA, 1695 bp, Homo sapiens
aagtcagtgggaaataaattttggtatatggctccttttacttacatgcagaggaagttgtaccaattcagattacataatttctactgtgtataatcagtttccagtgcgaaaaggtttaaaattcatatcatatcaccagttctgtatgaatccttaaaatcttaatgggactctaaaaaacaccttacagcatagataagctgtaaacaacattgttctccattgattcatgttcctccttggagtaattccacaattttatgtatccaaaaggccaaaaagttaataagatgaataaagattaatatttattgatactctggtttaaacattctcaaactctatgaggtatataattttattacctatatcttagcaatgaagtaaccaaggtaagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaaccttttagttgaattatcaattcttgtgtgtgccaacattcaaatttaataaatgcattttattcatctatacgttctcactatttttctctatatggtatttgttacgtatccaaattttttttaaaaaaagcagggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaaaaaagaaagaacagtaaagaaggtctcatgtaaatgagaaatgttctctacaatattattttagggggctacaacagcctggcagggtgcttaccaggatatctcgatgcttagcacagtgacttgcccatagtgtagattaaaggtcccaacactaggcttccagtcccaacactgcatctaaatatatgaccttggccattctctggctttactttatttattaaatgagcactttggactaggtaatctctaaggtcatttccatttatttatttatttattttatttattttttatttttgtttttttgagagcttgtctcactctgttgcccaggctggagtgcagtggcacaaactcggctcactgcacctctgcctcctgggttcaagcaattctcctacctcagcctcctgagtagctgagattacaggcacctgccaccatgcctggctaattttctttgtattttagtagagacagggtttcactatgttcgtcaggctggtcttgaactcctgacttcaaatgatctgcctgccttggcctcccaaagtgctgggattacacgcgtgagccactgttcccggtggtcattttcatttctataattagatattatatgcttctaagtgacaagagactaaagacatttccgtactgacctttgtatgtaatcagctgacaccacaattt

SEQ ID NO: 1725 - DNA, 8047 bp, Homo sapiens
agaaagagttttactaaatttcaacatgacagaactcaactgacagttttttgggcacgaagtaccaattatccaaaataaactcaatagtccacatgctcatgatctcccagtctaccgggtcaaacatccaaagagcaaatatacttataaagtaattattatatacaataataaattccaaatgaaaaatgacttggaaatactgcaataggagtatgtacgaagcacaacatgctgagaaggagcctgtaggttagccttctggggaagagaagggttagcctaagctcggtactgataactagggtctatcaattaaggcatattatgaggaaacctcagcactagtgaaacccgagagtaaaagccacttccactgcccccttccaggaacagaaaccgaaacataacatcagaaaatttccaatcaccaccccactcccaaatacacgtagagtgattattccagttctctgaactggggagggcgcatctttagcctagacgcccctctgggtgactaatgacaggtgagcacattgaacaaggtgactcctaagacaaggctgtatgtagccaacatcttgagagcaatctgaagttggagattttactacagccaaggagaaaacggagaaaaatacttgagaaatgtgttagctgtgttgttattcttaataaacggtaacgctggtcaacgacctgaacactgcagtgggcccaggtcaagcttgacaacatgtaaattttgccctctctgcccaatgcctctccagggctcccagccccaacgtctctctgattacagccccagtgagacccaccttcgcttcctctagagattgaatggcccctacatcctccaggccttcctgaagctcaaaaatgtccaaggtcccatccttgttatagtccaggtaccaaaagagatctccgtagagggagtccatcgaggatgtctccctcgcagctccgcggcctgagtgagccccagcggggtggaagtgcgaccgacgaacgggatctctgcccaccacacacgtccagtgggaagaggcctaagacagcatcctcctcaggggcgccaaacacaatgcaccttcatcggttaaagctctggaaggagagggctcatcctaacggcttcagcgcaaaggcgcgagcgcgcaggacccgggacctgcgtgggaccgcactctgggctgcgctgggagaccgcggagttcctgcctcactcacgtctgatcagaagccccggctcccactccaggaagagtccagtcggggcaactcaagcccctttccccagaaacttccagggagaacccagcacagggccatctgaaagtatagcttctcttttggagagaagtaggttgggaatgttgggacatgggctattgcagcataagtgactggcggtggcggcctgccaacatttaaaaaaaattgtttggctgcacctgtctaggaatccttctttttaaaaatccttataatgattttttaaaataaaataattttattgtagattcaggggttacaccatcagcttgttacaagggtatactgtgtgatactggggtttgagctcctaatcgtgccatcacccaggttgtgaacaaagtacccagtaggaagctttccagcccttgccctcctccctccctccccccttttggagtccctagtgtctattgttcccatctttatgccccatttacccaaggtttagctccccctgtaaatgagaacacagtatttgtttttctgtttctacaataattcgtttaagttattggcttccagctgcattcatattgctgcaaaggacatgattttgctccttttttatggctgcatagtattccatggtgtgtatgtaccacattttctttatccaatctgctgctgatgggtacctacattgtgttgtaggaatccttttctaaggttgcagcactggagaattgctgtaataaagactaggaattgaatgaaaatctgcccacatgggccctttcttctgtgacacctcccctcacagttttttatcttttatcttcatccaaccactacaatggctccagggcaagcctatccttcagctgttagtggctggattggaaagatgatctcaaaataggcaaaagttcagtgatcttgggtcccagagagaagtcagcagatactcataaatactatctaaggcttcctcttaatcctcaccctccagaaccacagagggccctggcttccccagaccaacacctgtgctccctcatcctgcaccactgggaatatggaggtgcagtttcacaataaaaactctccactttttatgtaatttattttcctaaatatggagattgggtaccctaaaaagttgaatattaaaattcaaaaagaaaatttaatttagccattatctgtaagctcttgctctacactacccatcatgtcagatactggggacaaaaacagaccatcacatgtccttgaaatactcataggtttccctctgggaggaggttgcaccatggttagtcaaaaaaactactgtacgcttctcagtaaacattttcccccagagctgctgagcagtggcaaatgtctaatgctgtttcacaagatgtgctgtggcccaatcaagaatgaattctttcaaaaagagaattttatggtccacagggaatggtccttccctgtgcaacacagaaaatgtaggtagtggcaaagagccacagaaggcagatagccaggcagagaatgagccttgggttagagtctacaggaccaagcagaaaagacagaagtcgtggccagggtgataaggaaaacaggctgacagcatttaacagaattgacaggagagaacaaaccatagagttgagagtttcatctaataaaaggcaggtagttttgttgaatagctctttctgctttttgaaattaccctgttcattatttgcttattattttttattccccatgcacctacacacacacacagacctacttactatagggagggttttgagaatacaatgaagaacgctgtcagtgttgttcaccactatatccccagttcattaaacaatgtctggcactgtttgaaaacattaaatgaatgaatttactatttatgctaagttactgggtaggtcttaccattcctagttaacatttgaggcctccaggcattaaataacatgcccaaggccacagtctagcaagcggtgaaaacatttgaaccctgttctgattccacagcctataataataactattacatccactaaaacagttaatgtgtagtaaacactatgatccacgtttcagagttaggcttcaaactttctcaacaaatccttttgttttcataaatcctgtcaaatatagataccttggtggactccattcaatccttaaaaagataagatttttgaactcagcagggtcaaaagaagttaagcagtgtattacagaatgttgtcttgtggaagcttcttttgttttttctggaataccgataaagaaagtgggctaggaagattataaaggtgagttggggccttaaacaatgggcaatcatataccaggcagagaagggggaatgagagaaatctcaggcagagagaagaaaataaagggatcaatgtacatggctgtggcctagtcagggaatatggcatgttgggagtttggaaaggtgacaaaaggcttagaatgctacaaagatagaaagggtattttataccttactaaagaattcttccatttttttcattctttcagacactttatttctgcagagaaggataacatcaaatttagaatataaatcaggagagaacacaaaagatacagattttatatattttagaacatttgacagaaatgtagttggaattccattgtttttcttataccataatctttctgttgtgatgccctaaaattcaccctgtgatttcatatcatgtcttcttaatattgtgccagaaaccataacatgtctgacaattaaaatattaaggaaatgggctggccatggtagctcatgcctgtaatcttagcactttcagaggcagaggcaggcagatcactagaggccaggaattcaagaccagcctgaccaaaatggcaaaatcccatctctactagaaaatacaaaagttaaccaggtgtggtggcatgtgcctgtaatctcagctgcttgggaggctgaggcacaagaatcgcttgaatccaggaagcagaggctgcagtgagccgagatcgcaccactgcactccagccttggtgatagagcaagattctgtctccagaaaaaaaaaaaaaaagcaatattaatgaaataaaaatgaaatgaaccctctttgttaacagaggaattacttaatggagtgaaatcctgattccactcaatgcaataaacatttgctaagctactattcttctatgtgactattttttctgtgattgtaaatgtaaaaacttaaagacagaattaaaaaaatcatagaatgtaagagttagaatggcccttaaatcaggttaccagtccacccactcctctaacattgggtgatcattcagcatacacttcatacccatgggcacagaggttcctcaagaagttcaccagctagtaaatgggataccacattttaaagggttttttaacatgaactttcatattctgcaacatatgaccttgttaaaagctctgtccaggatgcaggcaagatatctgcattttaagaataagaaagtaaagctccagtaaggctcaaacttgacaaggattacacggtcaatttacaccaaggacggaactctcttgtagcttgctgcttcccttcttgctcttgataattgtcctagtccaactgggctgctatgacaaaaatactattggcttacttaaaaaataagcattgatttcttgcagttccagacactggaagtcctagatcgaagtgctaggagatttactgtctagtgaggacccactttccggttccatggaccactgttttctcactgtgtcctcacatggtggaaggggcaaggaaggtcttccaggtcacttttatacaagcactaatcccattcatgaaggctccacaggaagaaagaagatgggggtagaaggaggaagacaagagggagaaggaggtgcgtaaagagaaaataactgaagacttttaaaaggaaataggattactagacaagtataagagaattagtaatggttaaatactgtatctccttgttctcacactacattctactctcagtctatacccttatactactgagtcctaggagaacttaatgtgaattttctctaatttttaactttaatttttcactaatttcatagtgaggagatttggaacatacagaaaagaaaggtcataccagaaaaaaaaatgtagcgctttcacttccaattggttcttaattttgtctcaggacttgccttgaattcttttctcttccctggataattctggaacacttagtaatggttagctattatattccttatacctatttctacattctactcttatttctacattctttccatctaaaatctaaagaaacttaaacagaaatttgttctcttctaaatgctcaattcattacaaatgcttggaaacacggagatgagatcaaatcagatgaaaatttatagagattttgcttcaagctgagtatttggcttagatacaaactactaccttgaaactttccaccgaagagtcaccccacagttctcatttctatgctcaagtagccaatgtcctcactccttgacattacataaacccctgacatgcctctgaaattttctcccataaaggttgactgtgtaatcctaattctatcccatgtgtgatggttaattttatgtatcaactcgtctggactaagggatgcccagataactggtaaaacatgatttctgggtgtgtctgtgaggatgtctctggaggagggtagcatttgaatcagtaaaccaattaaagaagactgccctcaccaaatgggtaggcataatgcaatcctgtggaggatgtgaatagaaccaaaaggcaaagcaagtgctacgttttgtttgtccccacaaaaactcatgttgaagtctgatccctgatgtggccgtgttgggaggagggacctagcaggaggtgtcagggttacggaggcagatccctcatgaatggcttggtgtcattcttgcagtagtgagtgagttctctctctcatgagactgaattagttccctcagtaatggatcagttccctcgaggctgggttgctataaagccaggacacccctcggattttgcttcttcacacatgtccacttccactttgactttccaccatgttgtgacacagcaggaaagccctccccaggagtccagcagatgccagcaccacgcttcttaaacttcccagcctgcggaactgtgagctaaataaatgtcttttctttataaattaccctgtctcagatattccactatagcaacactaaatggactaagacaggaaatgaaaaggaatttcacctgcagaataggagactttacaaagactgataccctgaatgagcgaggatgtggagaagcaagcactgtcagtcaaaagagtgaaaatgggtctaaggtttccgaaaggcaatacgtatcccagtttaaaatgtgtgttaccttcagactcagcaatgtccactcctcaaaatttatcttacgaaagtaactggaccagaatgagaaaatgaatacaaaggacatccattgcaatttcacttacaatcgtttttaaactatcaataaagtaaaaggtgatttaaaaagaattggtaacatatactatgacacaaacatataacagaatatgatgcagttacgtaaaaatggtgatacagcagcaattctcaagctttttgatctcaggatccctttacaatcttaaaaatcattgagcactccaaagagcttttgtatattgtagggaccatggagttgtaccactgagatctcccttcaaaggcacctactgtgaggaacacagttgacttccactctctagcctctaaccctggcatctgctgatgcactgcagcaaggtcgtccctttcctgggctgcttccagccaatgattggacatggtggggaactccaactgggccatttctgggacaatcagcacaaagtaccaaaagttggttccttcaaagtatgaataaaatacacaaaactttggcaagattgaaggggagaaaaggatagatatgaggaatgaaatagagaacctacctacagattcagtcagaagtgttataaaatcatcggtgagtattatgaaccttggacagaacaggcagtttcaaaaaaaattgtaacttactaaatctgactctagaagaaacagtaaactgaagaggcctataactaccaaagacattaaaagagaagtgaaatataactatataacagttgttggccctcatagtaacctaatcactttccctctttggataagagaatgccagtgtcagggaacgcttcaacagggttggagaagttccacatatctccaccctactaaaggggcagaagttcaggggcacagttaagatgactcagagaaaatgaaattgctcagtcgcaggtcaagtcaacccttcagatcaatttatgtacctagggcattaacctaggaatgtcttaaacaatggaatgccgccattccttctcaacaggaagtgggggaaacacgcgattggttttcaaacagttttcaaacagtagacaatacacatagctgctgtaacaaagcagcttcgaaagagatcgaatgtgtgcgcctttatacaaaacttgggacccactgaagtctgacagctaaaacggattacatgtctgcaaggtattaaaacagaaaacaaagaacctgggatggattcaggacaaaagtgtcttaaaaatttaacagtgcccgtgggccagagtgtcc

SEQ ID NO: 1726 - DNA, 8314 bp, Homo sapiens
cagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaatag

SEQ ID NO: 1727 - DNA, 1090 bp, Homo sapiens
tctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaatag

SEQ ID NO: 1728 - DNA, 8654 bp, Homo sapiens
gaaataggtggaagattattgagtaatattaagggtccaactgatgttgaaagtcaggcatggcagtaatctgcattcttcagtaatgctctccctcagtcctgaagagcatagacataggattagaaaatgtgggctgagcgcagtggctcatgcctgtaatcccagtactttgggaggccgaggtgggtggatcacttgaggtcaggagttcgagaccagcctgaccaacatggtgaaatcccgtctctactaaaaatacaaaattagctgagcatggtggcaggcacctgtaatcccagctacttgggaggctgaggcaggagaatggcttgaactcgggaggcagaggttgcagtgagacgagatcatgccacttcactccagcttgggcaacaggagtgaaactccatcaaaaaaaaaaaaggaaaggaaaggaaagggaagggaagggaaaggaagggaaaggaaaggaaaaatgtgatcttgactttggaggcctgcccagtgtgttggaaaaatctagggaggaagaagtctaaggtcctagtgaaaagactgaagtgagaagtgatgaacccagggaacgaggtaagttgagggaaggaaaggaggcgagggctgggcgcagtggctcacgcctgtaatcccagcactttgggaggccgaggagggcggatcacaaggtcaggagatcgagaccatcctggctaacatggtgaaaccccgtctttactaaaaatacaaaaaattagccgggcatggtggtgggcacctgcagtcccagctactcgggaggctgaggcaggagaatggcatgaacccaggaggcggagcttgcagtgagccaagatcgcgcggctgcactctagcttgggcacagagcgagactctgtctcacaaaaaaaaaaaagaaagaaaaagaaaggaggcaagaaggagactctttggactgagatactagggcagaaagtgcagccaccaaccaaaaatcttgttggattgaagagctgctgtgaagggaatcaagacatgggtgacatggcaggagtatgggttgtggtcatatagtgggaggacagtttttcacgtgggtttcctggagaggaatcagatgtttctgaccattactagctgtgtgccagcctaggaagttcattcttaagtctttcagaagtggaagaaagcaggaaaattgcttgctaaattacccatgaaagtcaaaaccattcttccttagaacttttgaaagcgaattgtcactaggacatatggggcttgatctggtcaaccatctcatgattttaaattttcatttgggatttttatctacctcttcatagcagagcaaaacaaacttgtctttttcccataaatataattaaaaaagagacaggctgaggatacccaccaatgggtcactctaggccctatcaaagtatgggatcaggatatgaagtaaatcccattaattgctgtaattgatagctccaaaagggagtatggcatacaattagaagttcccaaaagtttgctactcccctggagatgttataaaatagaatcagggttattagcccacattcaagcaaaagcttgtttaaagtggggcattttctaacttcttctggatagactaggcctctcttcacagttttgttaaatttagtgtttcatgaaacttaccaaggcctttaatattatgtacgtgcctttaattataagcacatatttcttctctattgcaagatttctcctgaactttacagatctgtcagtgaaagaggaaacttggataccacatgtggaaataacaaaagtgggatatgaacctcaattaactagcacataaagagtgctgttccctgaaaaaaactgttggattcatttaggtaatcatcgcttgatgaatgtactcttgctagtgtaaccttcttattaccatggagttacaaattaggtctgcaaaagacatctggaaacatctggccccttctaaagcaataacattccagtgtgttttttgacatactatgcagactcttccaataattctggatcttacacattgaaagctctcaagcgaaggtgctagttagatttttttaatgctttatttcccccaaaatagcaatcaaataactggatatacacatttccattttataatcactatcacactgtaatctaattacttgtttaaaagtgtgtctcctcactagattagccccttagagaacaaaacatgtatccatctgtgtaacttccttatgaaactacaggtatgtgctggaactgtatcctctacaaacaagagtactaataggtgagtagctttctttaagaacatttattgcagtattgttaaaatggcagcaaactggaactaaaccaaatgtccatcaagtggggaataattttaaaacttataataaatctatagatagaatattatttggcttaaaaaaaatgagttagagctgcatcagttgacctggagagatgtccatgatatattgctccatgagaaaagcaactaacaaatggaattatagagtgttattccaaattgtaaaagtaaacaatgacggcttgtgaaaaagataggtgtttatgattgtgggagaatattcataatgcactaacaggggttaccttaaggatgatcaggaattaaggtaaatgagtgtgggagaatagtgctagcaaaatgcaaaaatactcatgccataatgctaagggaaaatgcagaatgcatgattttagcaatagtttttttaaaagaaaagtttacctttcggtgtcttactggttgatgccaggcatagttcttaaagctctacatagactgtttcacttcctgcccgcaccaactctgtgaggtagggattattatttctttaatttcacataacagaaaactgtggtccatagaagttactgagctggccagtggtcacacaataattggctaagctaagacaaaataataacaggcaaataggcaaaaaatgaaattgcatttttttcctagaaactaatcagatcaaatgaaaagtatccatttaattaagtaatagacctgtggattattttttgcctcgaatttttgctattatttaatattacttcatttaaataaagtaaaattactaaaaataaatacaataaaatggctagtatggtggttttcaaaacctgtcctcaagtcctttgatgtgggaggtctgtgtttcttccctttgaattaggtggggcctgtgactgatggctctgggcaaccacataggagaagcaacattttgtgcttttggatgctgagtcaaaaaaggtaatacaacttcttcctggcttcctttttgggaagcttgctttggaggatgccagccaccatgaagtgagtctcatacagagaggaactgaggccccagccaacaggcagcatctactgtcagacttcagatggtgccagcctctccctagctttggaatcttctagctgaggccccagaaatcacagagcagagacaaattacgccaactacactttgtctgaatcttcagtgagcataataaatgtctgagtttttgtttgttgttattgttttgtttatgtttggttttgtttgttttgttttgctacaaattacatagcaacagatagctggaagagattctgcagtgatgttcgtcagtttggggtaggttttcccttagttttattcttctgctctctttaggcatattgtggtggttaattttatgtatcaatttggctgggccacagcacccaaatatttggccaaacattattctatatgtttctgtgaaggtgtttttttttatgagattaatatttaaatcagcggactttgagtaaagccgatgacattccatgatgtggatgggccttacccattcagataaaaatcttttttttttttttatactttaagttttaaggtacatgtgcacattgtgcaggttagttacatatgtatacatgtgccatgctggtgcactgcacccactaactcgtcatctaacattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattctatggtgtgtatgtgctacattttcttaatccagtctatcattgttggacatttgggttggttccaagtccttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttgtgatttgcatttctctgatggccagtgatgatgagcattttttcatgtgttttttgtctgcataaatgtcttcttttgagaagtgtctgttcatgtccttcgcccactttttgatggggttgaatagaacaaggactgacctctccagcaagaaggaattctgccagcagattgaactgcaactcttgcccgatcttcctgcctgccacctacctcatcaggttttggattcaccaagcctccagaatcacataagccaattatgtcaaaacaaacctttgtttgtcatcattgttttgtctgtgttttggtttggtttggtttggatgggctcaagtgatcactcttcctcggagccaatccagttcaattaagttcatttcccattgctacccctctaattttctcaccttgttcagcacacagaagagaaatcttacttctgctatgacaaggctgcctagatttggaaacataaaatggcataacataacctctctctctctctctctctctctctctatatatatatatatatatatacacacacacacacactctctctgaatagcacacatattacacacattatacctttaactctgcttcccaaactactcaccagttgcgcctgcatccaaacctcattgtagtatccaaataaatcacttctgtttaagttattatatatgtgatatatttaagaggtctagaaaagagactaatagtagcatagagtcagtcttctaaacttctttctctctcttaggacaaaaattggaagcaatatgcagccatttccaacaaatgagcagcccacatattagatggcaacatcaaggatagaaaactttaggaagataaaggcctgggaagtagattagctgtggctttcgcctggatgtggcttcatggagttacatatgccactgagaattcccgagtgacaaagtgatcaaatccaggcaaaggaaaaaaggaaaggtgcagcttacccctcgaagcagtgggcaactgtcagaacccacttcttggcaatgaggacacagccacagatatgtccactgggttcactctgcagagaacactgccatggccaccttccagggcgactcgtccgacctccaaggatccttttgttcattcgggcagcagggcggcgcccacagtctaccaaggagcagaagacacagtttgtgagttgatgccaaaccttgctaaatgcttagctctttgctgtcacttacaagcgatcactcttcccctgagccaatccagttcaattaagttcatatcccattgccacacctctaattctctcaccttgtttagtacacagaagagaaattttacttctgctctcacaagactgcctggatttggaaacataaaatggtataacattaagttacatatttcttgttcaattcaaacactttaccagtgaaatacaagacagctccaactgttaccaccagaaatcacattctctgagcatttcctgtgttaccacaggaaagcacattcctcttggtgcaggaattctcaaggcaggagtgtggtcagatattaatcatgttgtaggcaggagtatatggaatatatatacttctttttttagtttatttaatgtcatcataatttaatttcacatttgtgggaaaagaaactattttaacaaaatttcccacatcattttggctggtggaaccaccacaatgcaaattcaaactacagttctcaaggggagatgggagtactttttagagtcagtggtgaggaggcagcatgtcagatttttatgcttatacaaagtggtgtgtgctcaaaacaagttgagaaatactccaagatgagtaaaatatgacttcagaaatttgaagaacagattaagaaatggaatatttagactggaaaggagtcttaccaagactctcaaggttaaatttctgctatatgagaagttgacaagaggaaaagtagcttaaatttgcttcatataactttagacgacatgatcagaactagtaggtgcaatttacaagaattgtgggttcaggaaaagaattttctaaaatctaaattcaactttgaatgcaagaacatggtccctgttaaaggatctttcaatgtgatggcacaagataattcagtttggggtagaaattttaatcactaagttctcttccaaccatgaaacatttacattacaacctcaatgtaaatgaaaaaggacaataaaaatccatattgggactttcaaaaatactatgatgtacttagaatcctagatctatcagattgaaaaaaaaaaatgcaaccctaaatatataatttccacattcctttctgaagatttactgtattttcatttcttgctaaatttatgtaggggcaagtgcaattatttgcatacaataaattatgtaatacaggaaaagctcatttgctttctaccctcccacagtctaaaatcctctcttccttactctctattacattattctaaatttatttgcagcacttaccaaagcctaaaattatttttactaatttataatctttattttcacccccatatagtgtatgttccctgagatgagggccttcatttcccctcattcacttctacatcccctcaaagcctaatactgaacttggcattaaagaaatacttaataattagttgttatttgttagattgaaaacacatagctcttaggaataggaaaagtcatcaaagactattcatccaacttcttagtggaaattgcagttatataagataacacttgtagttagtaaaccaggactagaaccaagtttaccaactcccaatctagaatgcattatttatttatttatttacttgacctgaaaggttttttctggaattacaggtttggggaaacaaatcacttggttaaaagatttaggtcattgttttagaggaagtacttcaattgacaaatattcagaaatttggctgcagagtttgttttatgaggaaaatgtcaagaactttttaagaggaaatggtccatttttagttttcctctttaaaattcttaagaagtagcaacatttatgagcttcagagtcagatatatttatttagagttcagacactatcacttagcatctgtgggctgtgagatttgagcaagttatttaaatattcaagctgtaaaatattggataatcatccatggttcacaaatctattatgaggtttaaacgagtcagtgtatataagattacctagctgtgtgcctataaagtaataagaacttagtaagtgtaaatttcctcaatttatcttcctcctacaccccacccatagacaagggaagcaaccctgtttaagatgcaatgattttttagggtaaacttaagtgtactttcaaggcaacttgattataatttcatttttgtgtctattcctctcttagacattccaagttttcttagttatcattacttcagttccctctgtttactagttctatgtagcatctgcaggaaatgcagacatgagggtttattttgaataagatattaaaagtaatccaagattagaacccaagttcctctctcctcgccatgatagtttctgtaatcgtgaataaaagagaaaaaaaatctatgtctagaaagaagaaataaaagcaaccaatgttgaaatgtaaaggcaatagtaaatctatggaaactctttactgatatgacaaatttggattatcttaagttaaaaaatggaagaaaggcccaatgataaactcttgctctgtaatctgactctacacagctcttatgaatgcattcttacccatttactagaagttcatgtaaagtggtcccattgaggctctcccagttggagtgtaatgtcagccaccgcggctctttctcctgttcctgtatcaatttggtcacagatggttctctgatacaaggcaaatactggataagtattcaaagtacaatgatctttgaa

SEQ ID NO: 1729 - DNA, 1149 bp, Homo sapiens
accaaaatggtgcaagaaaagaacatgaggtatttataacagttggtttgaacaagtgcagggaaaagagaagactcccagctgatggatgcttccttttgagtcctgtggccaaaataatttggataacttgtactgttgtagggcaaattcatgcagagttccaatgtaattggttcacattgacctaacaaagaaacatacacacaaatatttttaaatttcacatataaaaacaacttctttaagttttacaaacttgaagtctattttattctttctttagagtagctaagactagaatgccagtagtatataacattttttatggatattgaaaataagtaagttgattagtgaagtgccctggcaactaagattcatttctgtatatgtagttgctagcactgtgacaacatcttgctttagaaagtccttcctcattttttcccttggctcaacttatctaaagatgactctctttcatcattccttttattgactccaattcatcttcttcttctgatttacttattactactaaaataggatagccccatcatcttcactgtcactaaactaattaatgaatttgatcaaataggcaagtagataacttctgtctatatgttttattgttgattaatgtgtttaaatataaggctacaagatttcagggcaagaggaggctcagatctgttgaatacttctcactaataagacaaaatccaaaccccttagcttgaagtctgaggctattttatacttcaaccctaggctaacttttcagcttcattgcctgtgattatccaatcaacagtatctctgctgtaataaattctattcccttatgacaccagatattttaagaattgtatgactttatgcaccctgtttgctcctctcttacctcctcttttataacatgctcataattatctccccaaaggtggtcatggttctagctgccagggccatacggcacctgctgcctggattaaccctttcccatcttccccaacaagctaactcctctgtggtctggaagactcagcacaaatacctcttccaggaaaccttcctggccaaccactcttcccattactacttccagaatgagtcttttgtgagtgcaatagcgtcttaggc

SEQ ID NO: 1730 - DNA, 165944 bp, Homo sapiens
tctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggttatataaactctgtgaatgttgcttaacttagtgacaagaggggaaaacaacctgacctgcttcactgctactcctgccacacgttaatcctcactatttgcccctaagtccctgtctgcccttagtatcctccacactgtgccccgccattaccctagagccacttgtaactcttacagcagttttctctgtgatacatcttgagcttcagttttcttttataatcatgtaatacataaagattgaattgagaaatcatcataaacagaagatattgtccaatggaaatttctgggagatggaatgttctatgttttatgtctatgctctccaattcagtggccactagtcacatgtgacagcttgaaatgtggctaacgcaactgaatatttagttttaattaaaacttaaataaccacatgtggtcacggctactgtattggctggtgcaaaacaatatgttatcttatgatgtaagaaagacagtagtcagttgtcttaaactgttacataaaaccacgtgtcataacatgcattaaaagaattatagatgcatggaagaattcataaaatcagcaaaataatttaacaccttctttttcccttaccttctacacatttatattttacttctttttagccatctatcccattctaatatctttctatgaatacattattctattgtgtacaatttcaacttacaaggcacagacattcactttgaattcagagtccacaactaagatattttctggtgcatccacagtcatttgaaatttgggtaacactgccagtaaaaaaaatatatatatattatattataatgtgtatattatatattattaacataaatacatattaacataaatacattcatacaaaacaattgtttctcctttacaaaccatcaacctttgcttatgtttgccattaataaacagtgtgaggaggacgttgaagtgcctaagactggattttggaattggatagaaaaatgcatattttgaattccaaattcatcacttctcaggtgttgaacttgggaaagtgtttctcaatatcttcatctttaaaatagtaataaagatactacaatagaaattttatgaagattttaggagaaaatatgaagggactaatggctaacatatgactaatgttaattccattcttctcataagaagtgctttacatcccagaaactatcatataaaatagaatccagatactacaaaaggaagatagatagcctaggttaacagagaattgcaggaagattatgggctgaactaggagataaaaatcacagtagatggagaaccctaaaatagtaacagaggacaaggaaagaggaaaggaagagatactcacttgaaaattcattatttaataatcctgcccttgcaaaattggaaagattttataatttttttattaataggtaatattttcattgctattatttaccatattcttccacagagaaggagtgatatgttttcttctcattgagcatctccacggtgatttcataccatccgaggatgggctctgagattaactggaaggagagttgtagaatccctcccacagactcctcattcacccactgttgtattcgattgccttctggatcctgagaataagaaagtgtatttttgcatgctggatgtttttattcattataaagtttcagcaaggtgtttcctacttaggtttccaactgacttaggattcaaaacatgagtgtgtcctcacatcacccaaggagaattggttactctcctatctgaggtcacatagatgcatattacagtacttagtatattttagagctagctgtgatttttttacatttattttctgtgtcaatctctgatttcttaaaggcgagccatattttatccccagtgcataaaacattaagtgtacatttatatacattcaacaactaaacattaaattaaatacaatcatacttgcccgttgtctatattattattgtctgtattaatgggtgcatgctaatatgaatcacatggtggtgggggtggaaacctatttctgtcctcttgaggctgtctacatgaaattaataattctgcgacaatttaaatagacaatcttccctgtgagctgccttttgattttgaggtttagagagatgttcaaaaaatgagaaaacaattcttcaactattagttatcttacctgaagggtgatcactggatactgaaataaaaataaaaataatgttaatatatgaactcaaggtttttttttctagatgagtgaagaggttaattataaatctattattaagcaaagaaacataaacacatttaggacaacccaaacaaatactgatttctgactgaaagtttgaatatctattgattatattgaaactcatctgcctagttttcaagaattttcatttacttctctctctttcacaacatacaccctgcagtctcagtaagcaaccctgcccttgggtctctccaacataataaaaatgccctcttagatgaatcataacttccttatcaacaaattcgtggtcagtcttcactctgacagttgcaatgttttacactgctggttgcctctttttgaaatgcttcaattttgatttctgtatctagcactaattttttttgtcttagattattggccattcctatactccaccatttccttatcagacaagtaaataaacgtagacatttgcccaagtttcccttgcagagtttcctctccttcttccttctccttccacctctctgtatctcctctcagttctctccatgtttaccactcttgccccctctaaacctatagtcaacagtttgactttcatctcttagtgttttctctcaggaccttaaaactaacaagttgaaattaaagactcctaggccagaagccctcatgtgaataggctgatgagaattttaaaaatgagtacatagggtcctttgcccactccccaagttgctaagtgctccttcccactaattgcagcattcattcactaataaaacgtaatgtgtctggagataagaacaggattcataaaccttgtccagaattcttggaactgagaaatataacagttgaattaagggcctacttgttattctaaattcatggaattgaatcttgatgaaatattgagatggtattgaagaaagctactgctgcaacattaactcaagcattaagagaggtagagcttctcatgagatttcctcataggaagaaaatgaagaatatattacccaaaggtgccatgggaagacgttaaccatttggatgagattctaataatgagaaatgaacctagagtactatccctttttgtttgctatttgtaatacttccaatgcagatggcttcaactgtgttcaacaaatttagtttttattacttaatttgtcttttttttttagatttttttttaaactcagcttggtctatttcaaaaaactagtgaacaagaacctagtaaaatcacattttcattgttctaagctgcttgatttttctctaaaaacaattattaaaatgaggctgattctgctgtagtcactaatgactgtctgcactaaatcttgtataaaccagccaagaaccaatacaacaactccttcatgtccccttctggttcatactatctctccctgtccatacacagggcctctttttagaggactagtagttccaggtcttaagataagtttaaagaaagatctgaaacttcttgatgcaaatgaaactttctggaaaaagtatgtttgaatattctacaaaacactgacttaaaggaaaagaaaggcaccatcagcaatgaaattgcagaaaatgaaagaaaagaccgatgtaagatttgggcagaagaaactaggtatatgctctatatcttggctcatttgataatgagcccagttgcatcattactatatttttattatgtagtcaaatttattatgaatgcccaaatctcataggccagccatgcattgaatctatttatctaaatggaatactgaaccagataatgtccagcaattagaaacactggcttgcaaagataaaaccacataatctcttagctgccatcatttttggaaatgctacatcaatttccatctctatacataagcacatgcagtttgttgtgccatggaaactccttgccataaacatttggtacaaatgatcttcttatctatgacccatatttgagggaacagtccattaatcctgttcttatgcaaatgtagttattactaaagcagggagttggataatcatatttggcctaattgacaataataagtcaacattggggggtgagaactaataagggagttatgataatgctgcagctgctttgattttcaagaagacctttacttccccatggtgcttccaatcaaggatgattgtcaaaggattgcagtagaaattctcactgccttggttaaatagaggagttgcattcttagaaatagaagcttcaaccatgaaccaaggagaacaggaaccacatgctatcttacggaagtgatttcggatttagattactacaaggtctttggagcactaaaaattagattcctgctctggaaattaaaattaagcaacagtctagtgaatgtagcataactatagaagatggggaaaggaggtggattaaaagtgacgatgtcttaaggatgaagtacaatttggagggaggaaaaggcactaacagagaaaccatctgcacagcttctgtaagcttcagaagcttcttcgtaactgcgctcagttgatagattgatctgagagaccacaaaagaatgcttagttctaacaggtttctaaactacatgaaatgaaatttgtcaggtatcctgttgtaaagactgaagtccaggtcataattcgttgtcttttgacagttttcactgttgatcgccttggttctcagattgtcgctagctagattgtagtcttctgctgaaatactgtcttagactaccatcaccatattagtctggtctcactttctattttatctgtttactatgctttttcatattttgttcatgccactatatagtagttaatatattgcattataaatatgaagcaacaataaactgtgcaatgaggttttagcaatcatagttaatatcacaccatatttttattcaaaaagaagcatgatgctgggtagattatgaatatttgtagcattataatctcagattgtaatgatcaattttttgaaaactgaatatctctcaattgtgtaagactcctggctcaatttctttgctatgttataacctttcctctgtgcattagactctttactagactgtggatggataagaaattttaaaaaagcaattttaaattaaggtttaatgtttctgtgctctttgaagtagcagccaccttccccacctctgccttctatagctctccttagcaagaatcctagaagccttccttggacatcctcttgtgtcaagcacatatactcttccccctcataagcacctcccacgccagcatgcatgctctcgtaatgtttgttccaccgttgttggtgccagcccaaactgtacagccatgccctgtctttcttgtctagtccttctttctctggtgcctaaatactgacctgaatgccctcttttgtgaagtgagggagggaggcaaagggtcaggggaagaggagtggaaggctggggatagcacaatgcatgcagtgcattcctccatctccagcacatatccctcacctccctctgcttgtgttgttctgggatcacagtgtgttggtgcctaagcaggctctgattactgtgattcccagttcatccacgactgcctcctcaagccatgatccccacatctgtagtgactcctcatgggtgttacttaactacatgaaaatgcctctttagttctatattcagggatttcctttaactcttctattcactgcagcttcttttccttcctttttttttcttttattatatcacattttattttatttttaattattatactttaagttctagggtacttgtgcacaacgtgcaggtttgttacatatgtatacatgtgccatgtttctgtgctgcacccattaactcgtcatttacattaggtatttctcctagtgctatccctccccctctccccactgcacgacaggccttgttgtgtgatgttccccaccctgtgtccaagtgttctcattgttcaattcccacctataagtgagaacatgtggtgtttggttttctgtccttgcaatagttttctcagaatgacggtttccagcttcatccatgtccctgcaaaggacatgaattcatccttttttatggctgcatagtattccatggtgtatatgtgccacattttcttcattcgatctatcattgatggacatttgggtttctttactccaaataagtctatctacttctcattttacggcatggtttttaaattaattctacctcagtgcttttttatgtaccattcatctcatcagaaatgtctatcttctgactgctgtaatctgtattcatcaactccttctgtacccaggaggagagaggaggcttttcagcttaattcaacatcatgctgatcattctattacttgggcaattctctagtcactaggggtatctcattacatgttcatgacatactttgttgctcttttgtttctatttcaaccataagcttgtaagtttgtgtaaattaaattcaaaatccccaaatatgtgattagaatgttattagaataatacggatattattagaatattattagaataatatggatattattagaatagaataaggtgctctttaaaaatacactttctgaggctccccaccccagactcatggaaatgaaatctctaacatttaggctatgtaatctatatttttattttgtatttttaagcaggttctctaataaactttaatacaataaaatttctgagcttgtattgtgtaccatcaattcaaatatcatataagtgacattagttgagggtaacctgatttaggtacactcacctttctgtccaggcttgtaggtgggtttatcagtctgtacaaagaccacattctctctggatctgattgccacagatctcctctcttccaggttgagagtggctcctttagcagaaaatgtaataaatgccagtgggtcagatctggcctgaggaacctagggaacaaataaatactccatgaaactgattttttgttaagaaatctctatcactgtgtgttggtatcactaaaagttttaattcataatttgtcatatctatttcttcaataaccaaccttgtttatttctcttgctttgtcacttccttatctcaccatttaaatggattcttttgcctttcttaaaacttcccttttctgcacaagagtcattctttctatatgtcttattcccttcaacaattttctatcataaaatcaaatgttttggctcttgcccttgttaccatttatgactgtacttaacatcatctcatactgaggactatattattcttttaaaaattaaaataactttacacatacagtcaaatagcctgatctctgtccctaaaaaatcagttatgtgggtggtgttcatgcacctgtaatattcttttctatattaagcagaaagaagtatttacctcaaagctgatgcatttgaagaaattttctccagtaacattttcttcaaatattttggtctggacctcaccatagttgagggagaccgtcaaaacaacagattcagtgagattaaaaagctgggcacaagctttatccaaagagccttcttgtagaacagaaggaatcagcagaacatactgcctacaaaattcaagcaagaccattacaattgaatgtgtgattagttacttagcaattattgtgttaattgaagaatttttgagtttaagagaagtatgttatttttaaatgttagaaatacatcaaatggctaaatctgtatgaaacagaaagatgttggcatatgaattaaatttttaaaagtcaaaaaggaaatcccaattaaaaatcagcaggtaatttgtcattagttctataaaggttaacatcatcagtgttcttgtacaatgcttttgcccccaaactgacacagcacattctgttttatatttgcctactgtttgtccagttccttccccagcagctgtcagacacctcttcctcaacataaatatagcactgttacagctcttactcagcattctggatatctacgaggcagagatgatgatgccaaccaaatttgaaatttactagtcccatgagcatattttgggttatattgtaaaatgataaaattatttaaaatcaaatcactgcaataaaaatgtaatgtttaattattattattattattatttattttttttttttctagacagagtctccctctgtcgcccaggctggagtgcccagtggcacgatcttgcctcactgcaacctccgcctcccaggtttaagcgattctccagtctcagactccagagtagctgggattacaggctcatgctaccacacccggctaatttttgtatttttagtaaagatggggtttcatttcactatgttggccaggctggtcttgaactcctgacctcaggtgatccgcccatctcagcctcccaaagtgctgggattgcaggcgtaagccactgtgcccagcctgaatttttaataccaagctctatttgccttccatgtgaaataataaactgtgtaatcactgacaagtttggagactgagaaagagacagatgaaagagaaaaacacccagatgtattatcttccacatcatgatccaatgagatgaagaaaaagtcaatatgccgtgtctgctagatccacatacaggtcagtgttctaggagcccagacgttctcactagtcagggaagccgagtatgggactatatatccatgcaggagattttgccagtatttcctgagtcattcttaaagtttaagtcatgtttaaattttagccatctcccagtgtgttacatgtcattaggtgtgttatctaatttacaaaacagtcttgcatcagcatttcctagacataatttacaatgcctatgagtgaaaatttcaagaacaaattaaatcccatttcagtaaattcaatcattgtaaattaatttgtatctcactattatttcttggttgagagctaaatctattttgagaactcagtaccaatttctggttggcaatgctctgtatagttattacaatggaagcaatgtaaaaataacaaaggcttaaggaagctctaattgaaaaaaaattaaatattaccatgtcttttttattactaattgttgatgttgtattttccatacgacatatttttatataaaagtatcctggtaggaaagtttattgaagcattactttttctttttttgcatttcattttcttcttttcctttaccaaaattattgccaggtattttgtgtttctttgtctttagagttttgactaaataagatgctcttagaagacaatcgcacgattgctgtgactttatcaagtatcacaaagtggtttcattgggctcagcctctgacattgcccttttactgaaaacagcaggaaatctatttaccaactgttttttcctaaaattcaagttaattatatcatatcctctttaaaaatccttaatggtccactattacctacaagataaattccaaactctttagaaaaaaaagtttcttaaggctcttatctacctatagcccccactgcttgcccacagacgttctgctttcttccctgaaaacaccagcaatgtgccacaccctttcatctctacatgtgtatttgtgggctcagtcttctgtctagaacctctctttatatgacttcctgtctaccaggtacatatatcctccttgttcttttgtgattcggttcaaactttcataattcccaagctgaagttagttgttgctgcttttagctcccataacacaggtactcatctctattacaggatgtcatgtcacactacaaatatttagtttttatgtaatacatgccacttggctgtgggaatctcagagatacagcctgcatgttttattcattgttgaatttccaatgggtggtatatgaatgcaagcacttcttgagtcaatcatgacttttagtcagtctcaggttttccatagaatcttgtgtctgtgtacaactaaccatattcttggggagcaaaataggagaatattaaccctcccaggaggagagcttctttccattcacttctttccattcaacccatcctatgctgcatttgaagtaagcactcttgactcccagacttttaaagcaaacccattattggggtgctagctttctatccagaggttttacacaggttttgtaatgcagtgagaagcagacgcatctttctgactaataatgtcttctgctggtttcccactgctatatattacagagaactagaaaagattaaagccagtatctgtatttagggtatggtcaacttaatgagacattagcttttattttattgttactctattttcacataaccctttctaaaaagcctgttatcatgcacttctttacctatgaaattttggccaaatctaaagacaattgcccttaatcatttgactaagacaatggactttatgctttcaatctactccttcctctttatatcccagttggctaacagtctcagattagtgactacttgtgttgttctttgtgaaaagcaacacccaaacctacctctctttatgtttgcctgttactgattccttggggtttcgttaccccttgctacaacactcattccaaagtgtgaatctaaaatgatcacttactatttgaggaacacagtcaggcatgtacttacatatagagcatctttactaattaaaatgcaaaatataaatcataccaatagtagggcacatctggagatcaaatgctttctcagactttattaacccattacaatttagaaatccaaatctaacatcgataacaggaaagttaatataagaaatttccaaaagacaaattagtacaaatgtttgaatttgttgagtagaaggtggatcttgcagtgcacttatcttttataaggagaattaaattcatctttataaacacacatacaatctcatctatctgatttgattgaagaaatcataactattaaatatttgaataatacccctctgataaataaatatatgagcatactacactgacttgcacatatgagaattttctagattgccagttagcacctaaaatttggagtaaatgccctaaccttctatctgggactcatgtttagaattatgatttattttcttattccatggaattataatacatatggagtaattctattaatattatttatacttgcctccaactctctaagttacatctgacttaaggtatgattgttcatttttttagattttcccccagatctcaaaagtgaactttgtacataaacattatccaaattgagagatagatataaatatagacctccctaatacaccttctaaatttggtaaaagtcttctaactgtttaaatgggaaacagtaagaataacagaacacatatacacatgaacacagacatacgtaagttttttacagtacaataacaatgttatttgcatacaggatacagagcagttgtttctaattctcagtctacgcatgggaaatccccttctactgtgggaaaagatttcatcatttactagacaagaaggatctcattcataaagttaagggtgtggagagagtgggaaaaatgatggtgtgggttgtctgttaggcaaactgggaatgccgtttccagcatatgaaaaaaatccctctttattcacatacattccaatgttcacttcctcatcctgtaaagcagagatgtgtttcattacaactataaaagtgcaatgctgggctaaagcctccttaccattactacaaaaaaggattctaaacaaaatctaaatcaatgcttctaactttaagatcattgctctaatgttttaaaaaaatgcatctgggatgccttttattataattttttaacagcagcaatttattttatgaaattaaaaaaatgagttcagtaattgtcaaaataaaacacaagtaagacataagtccaagtctgagtatattgtgaatactttggaataatgttattaataaacattgtctgcttttatggcagtgaatattcatatatttaatataagaaaacattttatattcaagatgcctttccctacaatgcaaagtaactgaagtttataggtaatatatactattaaaaaataaaaattaatatatactcatgaaaagtaaaaagaaaaataagaaaaagaataaattatgcttccaagcttagtgaagatctattcactcttccaaagtcattttcagaatataacttctctcctgtgttttcaccacctttcttgcttcactttctttaaagtatgaatctttaggtagtattgatcatttttgatattaagaaaatacaaagcttctggaaataattcaaatcattttgcaacttttggctgtgatcactttgcaaagcatgcagtgtttcttcgtagccaattgatgaagggtttagggaaatttgccaggaacttaccatgagtcatgggacaaatgggaacccgtcattccctctgcaaaacctgttcttgagaagccctttgtccagagcctcagtaggcagctggttcataccaaccaatggtaagcaatgctcatctgttctctcccttaaggcctctctttgtgtaaagacccacaagcataagtatctgtggtggggctgtgtcatgagggcaggctcacagtgctctcctctgagttaccactactgaacataatcagggtgtgtaaacttgttttatttggcattaaagccgttacaacaagttataaacatttccagagcttcttactagtggaagcagaggtagtctctcaggcagagtgtggttaggaccgaatgcactctgttgggaaaggcctgtggtaaatgcaacaccttggcacaagaaagttatacttttgttgtagtgtaaaccaaaaataaaattctaagccccccaaccaatagaatgaaccccttctgtcagccaaggacatcctacagtaaatctgaaacactagttcaggccatgataggagtgggaggtcagatgtatctgattacaccttccccctttggaatacaggcactgctgatcagcattaacatcaaaacagagagcttaagacaaaatactctttgtagcaataagacatcaacatgacagataacagggcctaaaagaaattgaagtattttaccctcaaatatatttctttcttttttttactcgaacatgatcattttttaaaaattttactttaacttctggtataatgtgcagaatgttcaggtttattgcataggtatatatgtgccatggtggtttgctgcacctatcaatctgccatccaggttttaagccccgcacccacaatatatttctttgacatattttgaaatggatctgcacagttgtcttttgtggggaaaatctacattctacagagaatcgccatccttttccaggtcattttcctgatccaggagagacttaactaagagtttggcacctttttaagtctgataagagacatttacaatctgttctctctgaagcctgctacgcagaggcttcatctgcataataagaatcttggtctccaaaacccgttatcttaacccagacacttcctcctatcgattccagctctttagataaactatgttaatcaagtgccaatcagaaaatctttgaatccacctaggacctggaagcacagttccctgccccctttgagctgtcctgcctttctagacctaaccaacgtgtaccacaaatgtatcgattaatgtcgtatgtctccctaaaacatgtagattcaaactgtggcccaaccaccttgagcgcatgttctcaggatctcctggggctgtgtcttcatgggccatggtcatgcatatttggctcagaataactctctccaaatattttacagagtttgactcttttcatagacagtagctttcagaaaactacaattactcaacctgactttaaaatattaacatattaagaatttggtttgtgtgtaaaacattcattcctttccttgtaaggtagttacagagaaggacaaaggccttggagcctcatggtgagtgtttggatcttggttctaccacttctcagatgatcaaccttggatgagttatttgaattccctgtgcttcccttcctttgtctatagatgggaataatcacaataccataccttataagcttgttgtggaaattgaacaagtaatatatttaaagtgattagaacagttactgacacagtaaacactgggtaagcctctacagagactaaatattacacccctaaccaccaaacacaccctacaaaattctagtcataaagagcattagtatgaacaatggattactcatgtcagccaagcgctctccaaaatgattttcctgaaatcaatatagaaacaactaaaaagaaatgagatgtcgtaagttctatataatgatgctatagaataaaggaggaaaggaattgaaaaagaaaagtaagaacatctttgtcaggtgcaagtaacagaatacctaaacagacttttaaaaaatcaaacatttataatctcatttggcacaaatcctgagaatggaggactggcattggttcagcagctcatgcatgccatcaaacagtttcctaaattctttccaccctacttccttgatgtgtcagtattatttgcaattttggctcctgacgtagcaaagattattccttcccagcaatatctcaatctgaatgaaaagagtgagcaggaaaaaattttcttctcctacatctctcttttcttttcttttctcttctctccttctttctccttctcctcctcctccaccttctctctttcccttttcctgccccccacctcttttacaaactattgcagatgctatattaggaaattttcctgtatagctccttatccacgcctggtttatatctctcattgctaggccaaagagtgtaccctctagataatccccttcatggcagaggcacttatgaccctagctgctaggaatgttggtggctgttggctgtcagatgaattcacctctgagaacctccctcagcatcagagaaacatttcacccaggttcctcttcctttctaggggcagctcagtgcacaataatgggtactatgtgtgtataaatgcacagctctgttgccttaaattaggacaactctgaacaatcaccccaaccccacagctccccacgggatatactgataactttattgtgactgccttgtagtacagctcctttttctgtacaatcctgcttccttcatcctctacaggtgttgatctttagaattctctccaataaaccctcttcccacaaatcttcatctcagagtctccgttttgtggaacctgatctgtggattccaatcactgtaagaggggactgtgataatatgattgacttaaaaaacaaaatcatgattcatctgagagcacttgaggcctgagcaaaatacacattctctaaacttacaaagaagaggaaaatctcatgtgtgagcaaccacaaacagagaaaagtggattgttcaagacactttgactattgcattgtgttggaaggatgggaaggagagaacagaaagttgtgagcaggataaaaatactaaaatgtcattctttggtacagtaaaaagaaaatgagagctcccaaagatcagtgaacagcaagaacaattatgatattaacatgggcagagtttcctaaaagaagaatccagagatggtctaagcagtgcttctcaaactttaatttgtacatacccaatctgaggatgatcttgttaacatgtggattctggttcagcatatgtgggtaggacctgacattctgcattcatttccaacagcctcccagcaatgcaagtactgctactcttctgaccacacttagagtagcaaggctctggagcctttgaaccccagttcaccattacctatggctggggaagcttggaataaccctgatgtccaagctatgcccttagatcaagggatttaaattgtggtcttggggctagtagtgccagtatcacttgggatcctcttaaaaatacaagttcttccatggtgtatatgtgtcacattttcttaatccagtctatcatttttggacaccgtggaatactatgcagccataaaaaatgatgagttcatgtcctttgtagggacacggatgaagatggaaaccatcattctcagcaaactatcacaaggacaaaaaaacaaacaccgcatgttctcactcataggtgggcattgaacaatgagaacacatggacacgggaaggggaacatcacacaccggggcctgttgtggggttgggggaggggggagggatagcattaggagatatacctaatgtaaatgacgagttaatgggtgcagcacaccaacatggcacacgtatacatatgtaacaaacctgcatgttgtgcacatgtaccctagaacttaaagtataatatatatatacaagttcttgtgcttcagccagacctattgagtcagaattccaggaatgagcctcagcaatctcaccatctgggtgattctgacacacagtagagtttgagaaccactgccttgcttcggcaatcctattaagttggtcgaagtgagacgtcacattaaaaacaaacaaacaaaaaaacctaggctcctagcatgttcaaggaaactccacccaagaaaaatgtgaccttctagtacacttgtgctagaggtttaaaagaacaaatccagcttattttggcatatgctgtcccttatgggatgaaagaaatgggtaactttttttctgcctaagtaagtaaatgatcaatttacagtcctcaatttccttgacacacttgcagcactggacactgttgactactcctttttccctgacagtttttgacctggcttccaggagaccacactgttttggtcttcctctgacttcactggtttctctcttacccagtctccttggctgatttcttcgcaatctgcttcctcccaacctccacatattcaagagcttcacagaaaaggcccaaattctcttccctattcagactcactgcctgagtaatctcttcccatcccacagtctatgtgctcacaattccacaatgtatatattttttttagctcagagctctctctttctctcaaactcctatactgattgtccagcctccaacctgatgtctccacttaagtatataaaatcaaaagctcaaagatgaattattaatcttctaccccaaacctatgtcagccatggcatagctcaggtaatggcaattctttccatagaattagctcaggccaacagcatgggaataatctctgatcactttttttttctcattccttgtatccagtccatcaggaaatcatactggttttactttcaaaatatacctagagtctattgcttcttaccagcttctcccctgctacaaccctggtccaagccacaatcaccttttgcctggattattttcacaacctccacgaggtctcctcacttctactcctgcactcctacagcctatactcaacacagcagctagctgattattttaaaacataatcagatcaggtcactgctctatccaaaaccctgcaaatcattcccagttttgctcagagtgaaatctaaagccctaacaatgacccttgatccccttcctggtttggtgccccaacatgtttcttatctctctacctactactgtatgcacctctttgctccgtctgctctagtgccatgctaacttaattgttgtttcttgaacacacaagacacactttaactttatgggccttgtttttttctagctgatctcactgccaggcctagattttccttagatgtctatgtggccaactccataacctccgtcaagactttgcccaaatgtcgttgcctcaatgatatcaatcctaagccttgtgtttagctttccagtcttctcacctcccagagtgttctatatcctcctgcccttctcttcattttatattttccatagcacttatagcctcttaatttcctagactttgcttacccattatgttcattattatgtttgcgcatttcgtttgattgtattatacgtattgtttgtctcccccattagaatgcaagcaccacaagggcagctgtttttactattttcatgcattgatatttcccaaacaccaggaagagtatttggcaactatcagcattcaagactggaggtctgaactaaagcagcatggcagtgctggataaaatcatgtaggtctatgagtcattcaggaggtagatcaacaattgtcaattatcaacactgagagaaaatgagatgagagagagaaggaggtaaatttgacccttaggtgatgggtgatgatattgtcacacaccgaagcggggatctaagttggagaaactggtttggagtagattatggatcctattgaagtgcctgtgggacattcagttaaagaagcaccttaggcagtgggatatgtggaactgaagtgtgaatatagaggcatatatttgggatacacaaaaatacagacagtaactgaaatgcaggatatttaatgtgtatagtgagaagagaagagggtttgcaatagaatcataaaaaaattatttaatagtaagagaaagtgaggtcaaaatgaagatcattaaatatccagaaagtgagaaggaaaatgtgattattatgggaatataatccatctctctaggatatggatataatccatctttaggatatggattatatgtgatggtggaaggaaaagaaaacaataaacagaaagaggctgaggataaagaagagaaagacaataaaattgatggaatgagaaggtggcgaaacaggatgagatttctagaacatagcaaaggagatgttagtgttaagggtttcagctactcattaaatatatatatctacatttatatatacacacatacatatatacacatatatgtgtatatatatgggcatatgcatgtatacgtatgcacatacacacatacatatgtgtatacacatgtgcacctatctgtacacatacatatattcacatgtacatgtgtatacatgtgtatgtgtatgtatacttacatatactatatgtgtgtatgtgcatgtatacatacatatacacatatatacacccatgtgtatatgtatatacatacacatattgtaggtatatatgtgtatacatgtatgtatgtatatacatatatatacacacaaagtttatttcaaattgcaaaaaagtatgtgattactgtataagaaaatgatagagacagttaattattattcccattgttcaaagtacttttgcatggagcaggaatggtggacataaaagtgccatgtgatgcttcaatagcacaaaccttctccaaatcagagctatacagcctccatgaaatattccgtggtagtctagtttactgaagacctcttcttaaacacacacactcacacatacacaatcacatgaatataatcacatcaaagcttggcactttccattcaacactcctgaattaaaatgttcattatttactataaaaatctggacacggaaaatgacttcagtactctgttcaaaaagaaactggggaaaggttttattgaaaaaggcaagggccgggcacggtgactcacgcctgtaatcccagcactttgggaggccgaggcgggcggatcacaaggtcaggagatcgagaccatcctggctaatgtggtgaaaccccgtatctactaaaaaaatataaaaaattagctgggcatggtggcgggcacctgtagtcccagctactcgggaggctgagggcaggagaatggcatgaacccgggaggcagagcttgcagtgagccgagatcgcgccactgcactccagcctgggcgacagagcgagactctgtctcaaaaaaaaaaaagaaaagggcgagtaagagagctgtattgttcatctacccacatctattctttagatggtatttttctctcagttccttaataccttacatactcattgtgacactgagaattttccaccataaaccttaaatccaagactttttctttgcctttagttataccaaatagctgacttcattatgccttccttgcttgcttataatttgaggagcaattttattatgtaatcaggttaactactaaatacataagtaaaatggggactgaaaatttattatttacttagaaaaaaaaggtttcccataaaggggtgttatgtaccacaaagtacactcccttcattttccttgaacctttatcacaaattgtactagaagagtcactcacattttcctgaagtggagtctctgaaaatccacagggcctagggtactttaagaatatataagtcagtctgagtatggtggtttatgcctgtaatcccagcactttgggaagccaaggcaggggggttgtttgagtctagtagatagggccagctgggcaacacagtgagaccccgtctctacaaaaaatacaaaaatcagctgagtgtggtggtgaacacctgtagtcccagctactcaggaggctggggtgggaggattgcttgagcctgggaggcagaggttgcagtgagccgtgagtgtgccactgcattccagcctgggcaaaagtgcaagactctctctttctttctttctttctttctttctttctttctttctttctttctttctttctttctttctttctttctttcttcctctctctctctctctctctctctctctctctctctctatatatatatatatatatatatatatagagagagagagagagagagagagagactgtcagtatatctagctggactgtcagtatatctatatatttgtcaataaaatttattctcttatcctataacaacacagcttccatcccagttcctggggattgggggataagcccaaatgacaggaacagcgtgtattatcagggttctccagaaggacagaactaataggattgatgtatatataaaggggagattattaaagagtattgactcacacaatcacaatgtgaaatgccacaataggctgtctgcaagctgaggagcaaggaagccaagtctgagtcctaaaacctcaaaagtagggaagccagcagtgcggccttcagtctgcagccgaaagcccaagagcccctggaaaaccactggtttaagtccaagagtccaaaagctgaaaaacttggagtctgatgtttgagggcaggaagcatccagcacaaaagatgaaggctggaagactcagcaagccagctccttccaccgtcttctgcctgctttttctagctggctggtagctggttggatggtgcccacccacattgtgggtaggtcttcctgagggtgggtcttcctctccctgtccactgactcaaatattaatctcttctggcaacacccagaaatgctcagatacacccagaaacaataattagcatccttcaatccaatcaagttgacacttaatattaaccatcgcagggcagaatttcagccagtgtggagcccatagagtgtgctgcaggagtgtctgtaatggagcatggccagggtcccccacactcctaggctttacttgctcccataggagactttagccttagggaaagtattagacccgaaccctgcggggcagtcttgaaaatgagatgaggtcagtccaacctgagcatccctttgtctgctggcctcttctggggcccagactggttgcacttgcttgcagtgcagcccccaagtacctcctgggagccttcattatagctcctgagctggtggacttcacctgaccaatacagtgctccaacagagcagccctcatggacatgtactagcctgcccgttccctcccaagtgcagcctctcccataccattttgctgatatacactcacccatgatcacccctgactttgccttgtttgcattcctcccccaccaatgtgcatgtgcacacgcaccctagcatgccactactgctggcatgagtgcacatcacgcccctcctccctgccacactgccactgtcattgaagtgtttgcaggcagagggcccaccagcccagctcctgctagtgccttgctcctgtgcccgtgccaacactgttgctgacgtaacactagccatggagaacagcagactcacccctgccctgagtggccactgccatccacatgaatgtgcagagggcacacatggtcctgcacccaccagtcccctatccccatgctaacatcacaatcggcatgaaagcatacagtcaccagcaggggccccctgtcccatagaattgtgctgccactactgctgctgggaacacctgcacagaggctggcacctcagcacctgctagtaccttgctgaagctgacaagcatgcaccccacctcactgctgctgctgcttctggtggcatgtgtgagctgctgctgctggtggcatgtgtgaatgaggaggaatcctgctgccactgcactgcagaatgctttggctggcaccacccatcagaatgctgtgaccagcagtctgggagcaccttggtccctccagcacatcaggttcctaaccttgaggagccagggaacaaagtcaggacctgagacctgtccctttgcactagtgcatgcagttcaggagtcctgagctgagccttggccttctaatatcttccagaaaagaagccagtaaatcaaacccaccttataccacaatcaaacccccaaagtcatcaaatagaataaaaggaacaaaatcccattcaaaggacaacaacttcaaagactgaaggaatatcagcctataaaaatgagaaagaaccagcatgagaactatgacaactcaaaaagccagaatgtcttctttcctccaaatgactgcattagctttccagcaagagttcttaatcaggctgatatggctgaaatgacagaaatagaattcagaaatatggataggaatgaagatcactgagattcaggagaacgttgaaactgaacctaaggaagctaagaatcacaataaaaggatacaggaactgacagacaatatagccagtatagaaaaaaatgtaaccaaccgaatagacctgaaaatgctttaaaagaatctcataatgtaattgcaagtattaacaacagaatagaccaagctgaggaaagaactcagagcttggagactggctttctgaataagacagtcaagaagaataaggaaaagagaatgaaaagaaatgaacaaaacccctgagaaatatgggattatgtaaagagaccaaatctatgacttgtttgcattaatgaaaaggattaggagaatggaagcaacttagaaaacatatttcaggatatcattcatgagaacttccacaagctagctagagaggccaactttcaaaatcaggaaatgcacagacccctgaaaaatacttcacaagaagatcatccctaagacacatggtcgtcgactctccaaggtcaaaataatctgtacaatgcgtccttcactttcttcctttcctccccacccctcactgttcaacagataacctgagtgcattcagtttgtaaagcacagtgctggggccgtgaaagccagagacgaatcagacaacacacaaccactctcaaagagattcagggatcccaggagggaagaaaggaacatcagtaagcacaacgccccgcaagcctgggtttcacatctgtttagcagcagcatgaccttaaggaggtcactaacaggtcaacgcctcagcttcttccactgaaaaacaggaatggtcacttctgcgtcactgaattacctctcactgaattacctcgaaggtgaaaaggagctggtgatgtctggtgctcctgtcctggctgacacagctaggtcctcagcattggctattattgcctgcaagacggggagtagtgaggggcttcaggcactcaggaaacccagaactcccacaagtgggcagggcaaagtaggcaaaatttcagggaggaggcggtctagagcagatcacggagagggaagctccaggcttaggagacagacactctgcaagagaacaccgcggaggacgaaacagcagagcaacagcaagcagcgcctctggctggagctgtgcctttcaaggagccgcagtaggaaccacgctcctcttggggtggcagagggatgggcaggaccatgcttgggctccctgttccaccgcctccaaagacgacatccccattccccatgagaatgtttcctatgaagccaggctggcccttgacctctgcagggctgccactggccctggcccatcatcatgccagtccctagaggctgatggtgagaagggagcagaaagcgcccactcctgacccagattcgctgcttctcctcccctgcctctgtcatgaccccagggaagcaaaccctgaaccggggctctcgccttcacctttaccttctccattctgggataaaagaccacacattggatgtagtgtacactgctccccaaaaccattgaaataaaaaataaagaatgatctgctcattatgcaggccacttgggggccaccagatgccaatgagtagaaggagagagaaggacagatggaggaagtaaggacaaggggaaaggggaagggagaaagggagaagaaaggaaggggagtggggaaagaaggagaaagagagggaggaaaggaccaagagccttgcagagaaaattccccctttttctaaggaaaggtgctgggcagtggtgcagcttcttgggtgaagatgttgggcaggggctgacgggaaaaggcagataacagcatccaaacttccacacacgaagtctgtcccctcctcttccccgtgccgtctcaacaacccccatcccccgccctgccttgtcatctatatcttgggaagcaggtgacatatctggcccaatattttggggcctagcttctcccaggtgtggagggggcagatgcagggacaggaagaagtggctgggaggggctggagggtggggctgaagagagcctgggaggtgcttgtcattccctccagtctctgcaagctcccccactgcgacagagcaggaggagagagcatagccaggaatgctaatttgccaggagctcacctgcctgcgtcacaaggcacaggtgccaatgaggccagggtccagtctggggcatgagatggggtggtggggaggagagagacagtctctcctctacccacctgtctcttctgtgcaggtggtttccgagcaggtgaagcacatttaaagggggaggttctaaactggtcacagtcccattgaaaaagcccatgggaaatgaaaagcccacacactcgcccattccattgccacaggcagggggcaggtggaggaggagcggtgggtgctccccacaccactcccaattatcaccgactcctccctttccttcattctccttcccaatctgtcagtgtatcctgtggttggtccctttgaatgtctcacccagccctccttgcttgcaagtcccctgattgcagcctcatccccgccatgtcctgactacagcaacagcctctgggtgtctctgccatctgctctctctctcccttcttgtcccctttgtgacaggtgcttgatgaaccttccccaaactcttctgacccatccctgccctgctcaggacccaatcacagttccctcaccctcctgaatcaaacctgaagtcctgtcctgagtaccccatgggccttaacttactcatcccaacttcactcattgccttgccccacaccctgccagggagcctcccatggcaccgtggaggacgcagaggaaccaaggcaaagctcctgtggcaccatccagagagaccaggcccacaggcatgtggaaagtcagcctccaaccccctgctctgcagggaaggagctgagtgcaagggagaggcagcgctgtctgtgcttcccgtgcagaagtcccagccccagcccctgtgcaggccggcctccccggcagcctgtcatactccgagttcccagccactttcaggcttctctccaagcctgtggcctccatttctagaccccaccccgggacctgcacaccagcctcgctaccttagccccctcctccaggagcctgccctgtgtggagtaggcacatggttttcctctccagcacccattgcctccttactcaagcaatggccctgtttcctctggggaatccatctcaattcatgagcatcagatcagactgcccccagagctcctcagtctaagccaatcagtgtgtcatagtccccagcctcagtgatggattctgggacagacacgaggaccaagccaggtgggatgagtgagtgtggcttctggaggaagtggggacaaaggagagcattctttcctgccagacctaaccctgggtcatgagtccagccccactggttgtcacctcgccaccacgagagcaaggcctgtctgggaatgtagccagcccaaaagaagcaagctgacatggaaggaaagcaaaccaggcctggatgacgtcgtgtaagccctggaactccgaagcctgctctactgattagttactttttgctcaacctggtctggagagttccgactgacagggtgccaccaatttttagtgatttctctcccctctagacccctggaagcctgtgcgattcatgctatgcaatgaagaatcagcctcgccctgtgctctcccattccggcctctaagctcctaaggacaccgtgttggccacatctttggtgtctctcagggtccagcacaatggggagcacacggtgggagatggatgtggtgacctggaactcaggtgtgagggagctgggacacaggcccaggattcctgagagacatcctcccctccctgggccatgcgagccacttggagaacctgcacccactctcaacgaactcagcactcccttccccaggatatgccttcctgccttctcctcatcccatccctgggcaggggacatgcaactgtctacaggtgcctagtaccaggatgggaaaggaaagccaccaaaatctaaggctgccctcagagaagggcaagcatgcagtcctcatcttgatgaggaaacagtttctgagggaatagttttcccctccattccaagcgttggacatgaggcggccataatcaggggctgatggctcttaaagacttccgtcctcttgccgaggcatcccttgggcacatttagcataacaataagcacaaaggagcgtccaacactttctgtaactgttggtagcaagttgatgaatggccaccattcaatgggcagtcaacgagtagagattatcaacaggcaagagctagcatttcctgaaggcttcctaggtgccaggcactgttccattcctttgcatgttttaatttatgtaatctttgcaacagttctatcaggaagatgccatgattaccacagtttcacagatgaggacattgaggcttagagggattgagtaagttgccaagggaacagagcaagcaaacagggaagccagatttgagccaaggcatcagctccaaggcaacctctcagccagttcagtgcaaagcctcttgtttacagggactttctagacaggcttgaagcaggccagtgagtcagtgggcaggggagaggcagaatagttaagaggatctggaggcaatgactatgcttcatcccccattttttagtttgggagggcttccaggaagaggtgggcttccagttcatgacagaagaggaggctgcacagtgaaggagcagggactccaggtctggtgacaatcaggtgtgggccagggtgagggtggcttgcatcaggagagggatctgagtcaggcagtcacatacttcgtgctggggtccctcaagaggcacagcctgaggtcccgggaagaagaccaagcctcatttcaggttgcttgcggccaaagacaggacctgtgtacccaacaacccctgggacctttgcaggaaacagcaaacactattcactcactcgagttagataaacactgagtgaaaagtcactggagccaaaggactgtgcggggtcagcgctgccgatacaagaactgcagccctccagctcggcttcctcaacggcctctctgcgctgcagccacactggcctcctttcaggtcctccacctcagggctgtaggtcatgtgcttccttctttctggaatgttctccctgacctacccactcaccctcaggttttaccacaaatgctatttcctcacatccaccttccctgacccagccaggccccccatgatgagcctcgcagaacctcatctcccctccacagaggtgatcataacccacagaacccagggccacgatccctggctttgaaccctggctctgccactcagctaagtctctgtctttctgtgcctcggtttcctcatctataaaatggagataacagcagtgcctgctcataaaatgtggtgagggttaaatgagttaaggcactcagatcaatggtggagcatggttaatgctatatgcatattagtgaatattataaataggctttatcacaactgtaactaaacaactgctcatgcattggttatttaggtctgtctctcctgccagaatatgcactccagttggacagggacgctgccttattcatcactggatctatagagatttgctcagtgcctcgctcacagtcactgttgggtaaatattttctggctgcaggaaagagtgaaggactagccccctcgccgtgggaggaagagcgtgagttgggagagcagagccaccacaggaaaccagggggcaaagtggggtggaaggcagtgagctctcaggctctcaggagcaaaagcttccaagctgggctctcaccttggcccctcccacccagggaagacagctgggtcttccaggaccaggaatccccaaaggggctgctcccagagggtgtattgctgggactggagagaggactgcccagaaccaccccctctgatcaggtgggggtgggtggcagctcccacctactgaagatgtctctggagaccttctgcaggcactgccaggcatctgccacctgccggacggtctcctctcactgcaggtctggtgggatgacgggcaaggcataggtctgacctgccagggaatgctgggtcctcgcaggagtcgtggtgcctgtgggtagcatcagagccacccacgcccaccggcacccactcaccacaggtagcatggtgttgagacagcacagccctcatcccaactgtgtgcacagcttcggggaggtggggagggggatgggagacaaagcatttggtgggaggccaggagctcataggagatgggattctgctgatgcctgctgagtgaatgagggagggagggggcaggacaagggactggggatttggtagggacaatggaggagctcggagaagaggcaacatttcttcaatccttataaggtgctgggtacctgccaggaaccctgtccatacacgatctcagttcagctcctcaccttgggtacacaagaaaggatccctggctgaagagggaaatagaggctggaaacaggggtacatgggcagggtggtggtggtgagagaattgcccgaatcagctgccaaatggtgcccaggttggaaacgcaaatgtgcacacatgggttcttcccactctaaccctgaggaattcgaggcctgcttctgacacagactgggcagtggctagtgactctaggtatagagtgtccagaccctgctcacccaggctagagcttagggagccagaaggaaggaggtgcatgtgggggtgcgggacaggagggaaaaacactccttaaattgcaaagtgagggcagaatctatttacattgggttgaattaactcctccccttgatgccactaaagcaggaatcacactgcagatggcactgatttgattggcaagagacatgccaggaagaatattaagggaccaggcccctataattaggcctaatcgtagcctgttgtttgaaaagggtatgaaggacattcatcaggcttggcactgtgccctagacctgctctcctgggtagtggggccctccattgcaacagaggtgtgggtgggcctgggagagtgtggcaagaaatgcttaggaggctctacttggccttaaagggctgtgtgaccttgggtaaattgccttctttgaatctctggtcctttccatttcccattctccaggctaagagctgcactctgatacacggttattcccaataataataaccatccaccccgtgcagtggtcataaaccagagagagaaatgtccacatgaaactaggtgctgcatgctggccatcactcatggatcattaatgaaaactaacttggaatcactattttaaggacaggatggtggggaggcatgcttgtaaacagagcccttggcgactcaattcatctgcaactcatttttcatatatgttaaatgtatcccttcaagatcattgcaaagaaaaactaagttaacataagaaacagtgcctggtggctagtgaacattctacaggtgttggatgctgttgtcatcattgttatcattatcagaatggacaagacagaaccccacagtcattcatttcagctctctttttggtgaagaaatgtgttgagcatttagctggaaacctggcacttaggcacaaggttggtgtagaaggcacctgcagacctgacccaggcgcaaggctaggcacccttgtccagttctctgctgacttacaggcagttctccctcactgctcctcacctccagaataaggagactccttcagctttgaagatgtgggaagagcaggggtgagggcaaggaagaggatgtctgagcattgaaaaggccaagaaaagaggctggagccctgaaggcaatcagcacctgttcccaagaatgcaaggctgggccttctcccctctcagacacatccatcatctgtcaagatcagccactcagagccctcaaccttgccccctcctccttcagaccccatggtacactcacaccaaggagggtgtcacagtgcagggatttcatccccagggcagctcattgctgggaaggccacagcacccagctccctctgctgccagattccaggccctgtggacagcatgtgtcacacagcaggtgcacacttactgtcatctcccttccttagtcctggaggtggtctctgctgtggctctgcatgccaccaatgctctctgaccatctctaacggcagcctttgatctcaaaaatgccccagcctctaagtaacccatggcagtatgaagccaacaatgaggaatttcttccgagctctctcctggagatggggtggcgggagggcatgcctgcgactgagataactcccaaagcacagcagggaaggaagaggagaacaatgaggaagaaagggagctgagaagggaggggaagcagacaggagatgaggcggtgcatggaagagagcctggtgccacccccataggctaccctatcacctcagtccctcccagcatccaaggcccttcctcagggctgctgtgcctatcacggccactaacctggctgctccctgagcctggcagccaacaatcacacagaagaagtccaagagcccagctctgcacaccttcagcactcctgtcacagcagcgggaaagggttctggtgtcatggacctggtgccttgagccaacctgggatgggcaatgtctgtggccactaagaagctgacctcagcatggtccggctgggactagaatgggagcagagacggggcttctcgagtctatctgtgcggtgggaaggtcttcctgtgtgtgtggctgcaggtggatctaggaaagggggataaaggccctgccttcagggcaccccaactctactggggagactcactctgacacatgaagcacaccagacatccaagaggcacatgaaatggtgagacatgacgggtgaatacaaaaagccaggaactccattctggaaaaacaggactgatggcattggatcaagtctgcaaaatcacaaaggacaataaagagaactgacacagacctgaaacagaaccccaggcatcccttgaagctcaaaagaatgatctaaggacaaataaacggcagttgagttttacacaacgggcaaaggcaaggagttccttaccgtggggatgacacaggataaaacatggctgagaccaggagaactcagataaactcgtgggagaaccacaatgtgctgtggaggggagcaggcatgcgggtacactcctgacctccacagacggcccctaccaccaggcctgatggagctgcctacctagcatgggtaggcctcattccttcagagaaatggaagaaattttaatttctttaaaataaaatcctttaattttaagagacttaaaatgaaaacctttaagccagccctgcccttgtgtgtgctgagttccagaaccaggcactgccagtgagcagcagagggaatgcacctgcctaggctggaggggagcagggcctgggggtgtgggtggtgtttgctattcttcccaggatcactgagcacctaggtgagctgagctaccggagtccttggaaagacccagtgcccttcttcttagggtcaagaaggaaggcacaaagagggagagaggctcagcagaagaggcccctaagctcccaaggcaggctgctggatgctgagagatgaggccaccaggtcaactgccctaggaggggaaggggaggggagagccctggcaaggaagcccccaaggctactgactccacaggaatcatctcctgagcctggctggggtggtgtgagcctagtgaaccacacgcgctcctttctctgctactccagcaggaactggccgctgtgaaccctcttcccacattagccggctctcacactgtgactaaagagaccagccaccacatggtcccggttacaggggcagctggggccttgccatctggcaggacctgctgccactggcgctcgctgtctgtgagcacagggtctggtgggcaggaggtgactggagggcatgtcttcccaaaggagagctcgccaggccactcctcagaggccccagcccacaccaccagctgcctctgctcctcccaactgtgcacctcgtgccatcgagggagggctgggacccagctccagggctgcggctggcagagaaggacctggcctcctgcccactgggacagagaggtagcgggtgggaattctaccttcctcacctcccgagatgtccacaggctttggggaaatggttgaggggctttggaagttcagggaaagaaaaggaggcccaggaagaggatgaggccagcctggacttgttcatccacagggaccagggtccatgtggctgacagtctcttggggaggggacgggactctgggtcaagaagcctaagtcatagacatagtcatctccctgcctctgcgcagactgctggggtcaaaaacagcatcacgtaagcaccctccaccttggagtgcactgtttggggcaaggtgcccccagacaggccctgttgctaacacttacacccagcagttccgatggacaagctgtaaggacagcctcgccccaggtgccaggcaccagagaacttacaactgacagccaaggccagctggtaagcccttggttcccagcgagagagcctgtgagcacagtggagcctcaggacagcacgatcagagctggcttctcaaaggcggtgcccttgagctcagtcacctctcgcccctttgccgcccattgctggcacctggcttgggctctccgtctgcccaacagctcacttcagaggaaacaggaaaccaacggggccttcgctgccctcctcagccaaacccatgcaaggccagcccatggaaagggagccagggagggtgagagtggaggggcagaggcctggctgcttctcctgctgtgatctgggcacacactaagctgcttagccaacagctctatctcctgggctcagggctcagccatgtgaggaggaagggatcagtacagccctgaggaagagtgaggacctcaagtcagccagagctggtgccccacaaactgctgtggaacgcgagcaacttacttaactactctgagcccccttatgtgcaaaataggaacaacaaacaggagctcccacctcctggggttgtatcggaaattcagtgaggtggtaaagcaccccgctccacgcctggcctatgagagatgctccacaaacggtggctgtgatggcagtggggtcaccaccacatgatggctgagcccagcagacaataagacatggaaatcaaccactgcgcagccactcgcaacaaggaagaaggtggaaaagctcatgagaaacaaacatccttatgacaggcttgcagggacgcctctgtattcagttatttttttctgctttggtttttgtgtttgtttgtttgtttgtttgatttcctgagatggagttttgctcttgttgtccaggctggagtgcagtggcacaatctcggctcaccacaacctccgcctcccaggttcaagcgattatcctgcctcagcctcccaagtagctgggattacaggatgcccggctaattttgtatttttagtagatatggggtttctccatgttggtcaggctggtctcgaactcccaacctcaggttatccacccgcctcagcctcccaaagtgctgggattacaggtgtgagccaccatgcccggcctctgctttggtttttaagactcaacaatgatagcctccttcattcccccaaatataccacccacaccccagctttctcaggctgattcagaggctgtgctacgaggcctctggggacccagttctccacagaactcctggctgaataccctgcctcagagtccctctaggacaggcccacacttcacttctgcgcaattgggaatgtgcgtgaggtacgggtgcggccgccatagaaggaaaggccccgggcctgggtcaagcccagcgactactggagccccttgttcgtctgttacatcctctgctggcaggcaaaggggaaagaaaactcctggccatcggggcacccagattctactctgggctctttccagaactggccatgggagcttgggcaggctgtgtcgcatgtctaggctgttgctccttatctgcagaatgggagccgtgctcactggtggatggaggaggggacaggggacagactgggtggcatcccagggctccaggcattggacagaaggcatgtccagggcctgggccatgcccaaaacaacctagagcagggcaagtggcagagcccctcccaggctgctggcaagggccccctggccctaaagcagcccatcctcatcccaccccggctagtgactttgaaagagcagcttctagatgctcagccaactacacacaaaggcttctccctactgggaacaaagtaagaataacgccaccctcacgggaccaaggaagctctgagaggggatccatgaagccagcctcgggaaccagaggaggcaggggggcggcgagagggctgggcagcagaatgttggctcgcctgattagctgaccccacccagaagaagacggaggattctagttctttaagggaactggcagacttcttctctaggagccctctacctcctgggccccaactctgaagcagctgcctggcagagacagtgaggagggtgcagggagaggactttgccctccactgctctccagccaggacacggccccggctggcagcctttcattctatactgagccaagagacacacaccagagccccaggctggccatgccccaccgcctctccagccccactgggcacactggtaagtctggggcctctgcccacagtcagggcctatcgtggcctggagcccacacctaccacactgactacagcaggactgagggcactcatggtatctcatggaaaacaaactgaggcccaggaggaaaatgtttgtttaaaattttgcacgccatttctccagggccactaagccaggtccacttactttgattactctttagtgctctccttccagccatatgaggaaaacatatatgttttcaaaacttaggaaaatactgtattctatttttcctcacttgaaattacatggacacacctgcaactgtatgtgttttttaaaactccaagaactgtacaccaaaaagagcaaacttaaagctgggagttgtggctcacgcctataatcccagcactttgggaggctgaggtgggtgagtcgcttaagcccaggagtctgagacaagtctggacaacatggcgaaacctgtctctacaaaaaccacaaaaattagctaggcatgttggtgcgcacctgtaatcccagctactggggaggctgaggcttgagtccaggagattaaagctacagtgagctgagatggtgccactacacctccagcccgggcaacagagccagaccctgtctcaaaaaataaattaataaataaataaaaagagaaaactttaaggcatgtatgttggtaatacaatacataattatacatatatacatagtatgtaaacttcacagtgcattgagaacattttccctgtgtcatttaatagtttcccaaacccactcatccatgcacataccatactttatttaaaatgttcccctaatgggccaggtgcaatggctcatgcctgtaatcccagcactttgggaggccaaggtgggtggatcacatggtcaggagttcaagactagcctggccaacatggtgaaaccccatgcctactaaaaatacaaaaattagctgggcatgctggcatgcacatgtaatcctagctactcaagaggctgaggcaggagaattgcttgaacctgggaggcagaggttgcagtgagctgagatcacacaattgcatgttaacctggcaacatagtgagactctgtcccaaaaaataaaaagtaaataaataaaatgttcccataatgtaagaaatttaaattgtttttgattttcctttattataaattgctctttaatgagcactctaacacataagatatttgatagcttttcttattattttcttaatatggagttttagaagtgcagttactggtccaaagatatgcctttagtgcccttagccttagttcttaaggcttgtagtaccctttgcaaagaggcttttctcaaaggttttgacacgctatactccaccagtgctggagtagagggctgcatcatgttagcagttatcagcttaaaaatctgtgcacatttggaaggcaagatggcatgcacctgtagtcccagctactagggaggctgaggcagaagaatcacttgaggccagaaatttgagcctgcagtagctatgattgcaccactgcactccagcctgagcaacaaggtgagatcctatctctataaaaaaaagaataataataaagaaaaaagaaaggcaaaaagtagtatactattgttgccataatttggatttctttgattactagtgatgttctgcattccttctcatgtttattgattgctaatatttcatgtacaaacctagttacagcaacaaccagcaagccacaactctcaaacatccttgccatcttagtgccattgctgtaatatataaaacacacattaaaccacagcagttaatattgtgctcgtggttaataccacagtgcagtagagacaggctggcatagcgtgagaagcagaggttccaagccagacagccctgggtttaaatgtctcctccctcatggaccagccatgtgaccttggcaaagtaacttaaccgctcttaccttgggtgtcatctgctgtggagctataaaatgaaacagtcatcacttccttccagggccccatgagaatcaggtgaggatgacacaggggaggcaggtacacacggccacacacccgaggggactcagcagggggcagtaatgaccacaggggacactactaaagggctgagtatgcagagctcccatcccggagagaaggggggaagaggatgatgccagtgatactgggctgtattgttaggtcactaaagtccagtgtggcatccaaaagtgtgcctgtcagaccgagtcttcccgtcgagtacgctttacagagggcctcatcctctgagggctgaccgtgggaaggcagggaactggacccaaagatcctggcttttcctccccaggagaccagggataagctcagcatccccatacactgaaggcagcaggaagctggctgtctaacacctctcttgctttgtaagagggtccttcctaatgcagagctggggaaaggagagacgctgggaggggctagcatgccgcaccagggaaaggctggtgctctcagcggtggctggctctgcctgcagctacgtgactgagagaagaaagtcattcagagaaatcccaagacacagagagcagcatcgtggcttagatccctcttgcctccctcctccgagggctggcagtggggagtgtatatacctccgaaaatgagagctggctaatagcaggaagcccagggcctctgcacctacttacctcccaccagaagaaagcaccattcctcagcaccacccccatcaactcaggcccaggaacaggtgaatccacccagccagacacaagcaggcggggaaagatgcagggagataccccacctgcgtatctccttaaatctgctttaaaatcttccaggaggctggcagatcactggagctcaggagttccagaccagtccggccaacatggtgaaacccatctctactaaaaatacaaaacttagtcagatgcggtgtcacgcccgtaatcccagctactcgggaggctgagacacaagaatcaaacccaggaggtggaagttgcagtgagctgagatcgcactactgcactccaaactgggaaacagaatgagacctcagctcaaataaataaaatgctccaggagggaaaaaaaaaaggagtgagagtagatggaataaagtcacagtagaatgtggcatcaggtgagggtgacataggggttcactacattattcaccatatttttgtgcatgtttaaatattcccacaatatataaaagctaagaggaaaaaggcgagtaatagaaacagggggactacataaggtcatgatgcctgtccctctttgtcaaacttctctgtacctcttatcttggagatgccctccctgttcctgccctacagccagcattcttttgcctttattccatttcacaatttccacatccctggctgttttcctcacccccactcagctccttgcttatcgccttcttcttcaccctccttgtcacgaccctgtcagaagctctgataaccctccaagaagaccaagtccaagagagcagaccaggaaccaggactcctgggtttcagccccagcaacgccactgtctgcacctatgcaactaacccctacccagttcacatcacatgaaagcccagcagagcccccaaagagatgttcagaagtcactgctgctgctacttctacaaggcaaacaaaggagagcccccatccctcagaacctgtttgctgggatccacctcaggcagcagaacagggacatggaccaggctgcctggcagggcaccacggagggctggggaaatgggaatatagatgccatgatgatcatattaatgagggtaaaaattaggaccaacaggggacgtcccctctgcacatgtgtacaagtgtgtgcctttcacagacaatagaggctgaagtcagggaggcagcatgcacaggcaggcctggctcagacaggggccacgtcccagtcagacagtctcctgccacgcgttcccagcaaggatgtgaaaacagccctgccactcgctttccacccacacccctccatgccttgcctttctccctctttttcatgagggaggagagtgtgctcgccctcttctctcccaggatgacagtcaggcctggaaaacagaaggcaggaccaagggacaaatcagggtgccctcaggtctaatgccagccatgtcctgccatactgggtgcctgcggaacccacatacccctctccaggctgagaagatggccacctgacctcctttgggaggtcattcctttggggtggtcatgttttgggggaaaccagagagaacctgaagtgaggaaacagcttggggatgaaggtgctgtacagacaccgggccagtcccgccggctactcatgtttactatgcacagccagcacacccatgggcgaaagaccttcggtgccccctgctcctaagagctaagcactaaatagtgcatccgctgctgctccctgctaactctcccaatggaccctcacgctgccccactagggactgggatttgaagaggtaacctttaactccattgttgagtgaggaaataagggcaagggattttaccctaaaatagggaatatagactagttggccttgggatctaaagccaggagtcccgactcccagccagggctctccccatgagacatgggagagttggccaagctttctggggaagagcaccatctggggttcggttttcctagctagccaaggagaaggagccggccctgacaaactcagtgacattcacacagggcatcgtgggaacaaataaaagccacaaaccacaattcaacacaaagcaggctggatcctggcagctgcagactgatcagcccaatatgtcccgggggtggggcaggagaggactctgagatgcccgggaaggacatttgtcatgccagccagaccaaggctgccccgcagagtgagagcaacaaaggatgcagatccaggaccaggatcacaggcttagctcagctgcttctaaccaggagccttggacagatcacttggcctctctgactctcagtttttctacctatagagtggggataatgcatcttccttacaggaacaatagaagtgctttgtaaaccataaacagcacaggaaaatgaaggaatatcctagtcctcttgaggattagagggggagggaagaggagggaaggaagagaaaaaggtaggaaaggatccaaaatgaggctgagattttgaaacccaacctgctggctttatagccaagcttttcatcatcactggaaactcaaacctgcagcaattatatgctgaggtcataaacgtgattaaaaaggttgtttgcaaagctgattccagggaaatgagctgcagatggcggtggcatcaatgtccttttgcagcaggcagcagctggctgtgtggactcagggacagctggaaggagttgtgctaatgcccacccccagctttggaaggcgggggcaagctgactgccctctctgtgcctggggacaggggagacttgcagagagctgaaaccctaagccataaaaccgccatttgttccagagagaaaagccagtttttcaattccagcccaaccaggagggtgggccaagctcagagaaagaagagtggactgagagcacgagtccttccacggcagcctgcctcgggcgggacaggctgcagtggctctggctgtccactgggagtgtccttggtgagggaggaaagaaggcaaagccacatctgaagtctctcggccagaagaaccctctgttctgaggccaacaggtagccctggtataaggagaaggtggaaaatacaggcaccagaaccttctctgctgcttatggcttcatagaatgttttgcaggtgacatttcacataagtgggcaccagcctgtctgtctttgatggaaagacatcaggaggcaggacccaggtctctgtcagtggcttcctgtcagagtggccaacacgggatacttaaaaatgtgaagaaggagacgtcgatcaggataatacaatgagcccttggcccaaatttgggaagggccctctcttttgatgtatctcactacctcagctgccatccctctcctggtcacttctacccatgcttcagccacagccccacttactccaggaagccctccctgatgagtcacctgcagcaacctcctgtcctgcagatcctcaccccgtactgctcactgccttggctgctgctcccaatcactcatatgcgtgcccatgtctgtctgacaactgggcgctccctaatggcagaagcacatccatatgacatttctcaaatgttccctatagtacagggaacccagagcacgtccaatgacgttgggatgtgagcctgcagagcttttcacaaatttgcagaacaagctgtgtccttcagcatcattacctgccctccccctccgactgaacctggagaagagtcaacagcctgctaccaaaaatcccccacagcccggactcggatgattcgcctacaaaggctggggagcacagtcccaggcttactaatctcctctctaccccatccccattttttccagtccccagaaagtcccaatcaatctctcagcaaattccacaggatctgtcagattcagatccagtcaactgcaggccgagtgctcttcgcatctcatcttatctactgcaggaagcaacctgagggcagcaaagaggaagacagctggtatgaacgggctctgaaacctaccagctgtgcggcccagagaaagctacctaacctctctgagcttcagctgcttcagctgtaaaatggcaagtataccgcctttctcaggtttactgttgaaatcatgtttgtaaagtgtttataaagtgtttagcactcttagaaagtactcaataatggtaattaacatgaaattatcataccaatctcttcaggtaggtattattgtcttctgtctaccaatgagggtgaaggtcagagacgttaagcaactggttcagagccacacagtatctgctcaggaggcagagctgggggttcagacagagcagcagagcgtgccctcagccctggggaagtttgcaacctcaagtcacagggacagagtagctgtgggaacttgggtcaggtacctccacccctccccaggttcagcagctccccaggaatcctggaacatgaggcatggcctcagcaagtctccatttgagagaatcagctgggatctcccagattaagtgttgttgcaggcagctgggccaaaccgcctgccctggaccctagagctcatcagattggcacctgctcttcccacacaggcaaacacggatggtgccactggccgaaccccgccatcagccttcacacagttgagctcaccaggaaagcagaatctctaaaactccagctgcagtgcaagcccagcccccagggacaccgctgtccacatctgaaatagctggcgatcatcacggggtgggagacaggatgcagtgggcaccttccacattgaaacccactcaattaaaaccccacgtgtgggggacagacacacacgtacccatcacacccagtcttacgtgtccactgagaccctggttacgttagacatggcctcaaaggaagtaggtactttcacaaacatcatctcctttgatcttctcaaccaccctgaggagtatgtacttttgccccactttacagatgaggaaactgagaagacatcaggcaatttttccaacatcacacaaaggataaggaaaatgttaggatgccaaccccatgtctccaggtttctttccactacagcatgctgttcatttgtgatctcgttcattcatccatccttccttccactcattccttcattcactcacctatatttttccctaaacagctacaggtcaccactgtctgggttgtttgctactaccttctgctgctgcctgagaaaacctgggagactgtgatcacattttttttcctgtagagctgcccgaatacagctcttctcaaagccttgcagcagagatgatacagccatcagcagctgatcctggaatgagtgttgagagcagcacagaccactctacgtttctgctctgaccacaggtctggcctagaatttgcccctccactgcacaatgcaggtaaaaacctttaaaaaaataaataaatggtctctgagcctcccagaaatacagcacttagaatgttgtttttggagggggcatgtgataaagaatgggaaagataataaagtagcctgtcacccagctcacaggcaggtgcatgtggctgcaggggatcgtttagtcaatttaatgacatatttgttgagtatctattactgtgcctggtacgggatggagtgggtcagggaataggggagggcacaaagggagtcaaaaagaatagaaagaaagccgtcaaagggctgatggtctggttgagggaaaaagacaggaaccatctgcttagacaacacagatataaagtgtacttgagaaattcagaggatggtaaggtgcctgcaagtggggacacaaaaatttcattcagaccatggaatttcagctagacagggaaggatggccagaatttaaacctgggatggtatagaagaaaattacccaggccaggcgcagtggctcacgcctgtaatcccagcactttggcaggccaaggcgggcggttcacctgaggtcaggagttcaagaccagccccgtctctactaaaaatacaaaaaattagctagccgtggtggcgcacacctatagtcccaactcctcgagaggctgaggcaggagaatcacttgaacccaggaggcagaggttgcagtgagccgagcacgcaccactgcactccagcctgggtaacaagagtgaaactctatctcaaaaaaagaaaagaaattacccaaactgcctgctcaacaccattgctaatgaaaaagcctgccttggtctctccttccctgatcttagcttttctttctatctctgcaaagcctccgtatagaaatctggttttattgtgcctggtaagggtcctagttcagttctaaaacaattaacaaccatgaagggacaaaagtccgaagtgggcatctcgcttatggcacatcagcctctagtcatagtcaccctcagaccccatctagcggctgcccgaattatttcattcagggatctgtgtgtttggctgataaccaggcaccactggcccgtggggtgctatgactattgcagtgttaaaaacaaggcacttggctgggaagacgtctgccgttaagtggcaggctcatggacaacggcctcaaggtatttttccttcagacatttggtcccactttggcaagacatcttggcattgcttgggcaagatattacgctctgcttcttcagagcgttgggtgggagataccccatagacagctgaagggactgggaccttgggaaatcacatttaaaatttttggacttgtttaaaattgtttgacttggtttaaacacagttcaaagcccagctgaggcattaagggtttgtcacctaaggttgtcatctaaaatgggaaatgtgtgctctattcctccttgtggcccggtaggatgtattctgcagaattgggctgcttttagctttgagcttgtgaaaaagaaaaagttttttttattgcaatgcttcctggctataatattccctaggacctggggaatggtagccaggatttggatctttaacgtaaagccaagagctaaagaaaattttagttagttgttagtcatggtggacacatttattggacaggtgcaagcctttccctgccacactgagagggtttcaaaagccttactgaaagaaattttcctcagatttggggttccattccccatacacagtgataacgagagtgcctttattgccactttattgccacttttttttgagacagtgtcccactctgtcacccaggctggagtgcagtggtataatcacagctcacagcagcctcgaccttctgggctcacaggatcctcccacctcaacctcccaagtagctggggctacaggcacgcaccatgtctggctaattttttttttaataggaatgaagtctcactatgctgcctaggctggtctcaaactcctgggctcaagcaatgctccagcctcagccaccccaagcctgttgatttcaccataattaacccactgtctaatttctcattttctgactcaactacaaattactgcataacagaaaaatagcgccgggcgcagtggctcacgcctgtaatcccagcactttgggaggccaaggcaggcagatcacctgaggtccggagttcgagaccagactgaccaacatggagaaaccccatctctactaaaaatacaaaattagccgagcgtggtggcgcatgtctgtaatcccagctactcgggagcctgaggcagcagaatggcttgaacccgggaggcggaggttgctgtgagccgagatcgcgccattgcactccagcctgggcaacaagagtgaaactccatctcaaaaaaaaaaagagagagaaataccattacatgtcccttgcttctaggagctaccttgatcaagtttgccgaagaaggaatcatatgcctcccctttgtttagtttactatcagattgatgggaattctagatgcccttactcttattactgtgattccctaacagcctgttcaggaatgcctccaagctgtatcttggatcgagttaaattcagcaactccttactacaaagcaacactcggaaatagacctaccaggtccttggtttaatccaatccacgaagccctgctacaagattctaaacttaatctatacaatctttctgtgttcctctgtgcatcctcagaatatctatttgtttgtaggggataacaagaaaccctctggatgtatgaatgtattgacagctagcatataggaggaacttgcctgtaaggatactcatttatcccagttttctgtacacaaaactgctgaaaccaagcactggaaaagctccctaaaattacttggtaaaactaaatggtccacaactcactttcgagatatacagattcatacttgcctggtaccaagaagacagagctgggtatttcttcagataaactttgttaccttggcggagaacggtgccccatgagcgcagaattagaaatctctccctttatgaattcttgtcaaggaaattgcaatcgcagcccagcagagaggaattaatgtattgggtcaggttgtcttagataataggatagccctagattacatcttagcggagcagggaggagtatgtatggttgcaaataccgcgtgctatatttacataaacgaatccgtggaggtagaaactcatctaggaaaagttagagagcaagccacttgggtacaacagcctcccagactgtctctgaggactggttttcttttctgttttcttggattcctcgtggaaaacagtctatgttttctgggtggctaaaactaggcatgtcagtcttgttaattgtgcttatgctttctattatgaccaaatgtgcattaaaatgttgtagtgaagctgtgactaaagcaactaatacaatgatagttcagcaccacggtgccatgcctgggactcgtgaatattgtgaactccatgctattatagaaactttctctcttcatatcctagtccccgatctttgccccaattcagcaggaagtagccagagtggtctgttcccctatacccctcaggattgtggagtgacaaggatggaactgagctgcaacaggggcccctttcttaggagcctgaagaccccaagcatgaaaataaagaaaaaccctaagttccttcaagagaaattccaggcacctcactatccccagaagtaaataagaaggtaatagtagcctaaaacaagagccaaggacgtttgagttccagagatgtttgctttccctgtaggaactaaagacaacagctgaacatacgtccttgagttgtctttcagaaacccccactgaggaaccacaccgaacagatccactggcatttagacctcagataagggggaaactgaagataaaacttcttcctgatggggcttagagaaagtcacaccccatcccagccagttaacatttttctgcagatcccaaatttttaaacaaagcttctcttctttaaccagttgcaaatccgaaaatcttcgaatctacctatgacctgtaagcccccctcaagatatcctccccttttaggcctaagtcaatgtgtaatctccatgtattgatttacgattttgcctgtagcttctgctttcctgaaatttactcctgcctttaaaaacccttgcctgcaaaccattgggaaggtcaggatttgagcatttaactgcttggtcctctttgcttggtgccctgcaaatgaacacttttctgtcactgcaaaacctcagggtagatgtctggttttactgcaccaggcaagcagaccccagttcactataacagaaggcggtgaggaagaacttaggtttttattccgagtttagcgggaagcagaggctattaagctgagttacgacatagtctcaccattttagtccaagtcttagtcctagcaaaacactttggctgctgtgtggaataacgcttataagaaaacaagcatgaagccgaaagggaagtaagggcctgggcgcggtggttcatgcctataatcccagcactttgagaagccaaggtgggaggattgcttgagctcaggagttcaagaccagcctaggcaacatggcgggaccccgtctctacaaaaaatttaaaagttagctacacatggtgctgcatgcctgtggtcccagatactcaggaggctgaggtgggaggattgcttgagcccagaaggttgaagttgcattaagccatattcacgccactgcgctcccgcctgggcaatagagcaaaagcttgtctcaaaaaaaaatttgtttaaagacaagtaagggaaatcttccagtattctaggtgagaggtgatactctagactaggttgaaagcactggtaataaagaatagtggatggaccggggatatattttgggagtagggccagaagaatttgctgaatgcctggatggggaaaacaagcaccagggagagctcatgagtgtctagctagagctacggaagaagatgggagaggggcaaggcaaagggtcgaaatcaagagttctctttggttcaggtaaatccaagatgaaattagatgtctggacaacatgccgaaaagaagaaaaaaaagaaaagagaaattagatattgaggtggaaatgccaagtgggcagatggatacacccatcctgagttctgaggagaagtctgccctagaggctatggacaaatctacgcaaagatgacacttagcatccaagaattgcagaagattagccacggagggagtgcaggtgggaaagacgacccaggcctgagcccagatggaggggcctggcagaagcagaggagcagttgccaccagggcagctctgcagaaccatctgaacttgacaaaaccccagaggcagcagtagggagccacagatatgactgggattaagcttcatacctgggctgaatgaaggcttagagtcagaaatgttccctgttacagaaaaattttaaacttgtacttcttggccaggtgtggtggctcaggcctatgattccaacattttgagaggccaaagtaggagaattgcctgagcccagaagttcaagaccagcctaggcaacatagggagaccctgactctacaaaaaatttaaaaattagctgggtgtggtggtgcacacctgtggtcccagctgctcaggaggctgaggtgggaggatcacctgagcccagaaggtcaaggctgcattaagatgtgatcattccactgcactcgagcctgggcaacagagcaaggccctgtttaaaaataataataaatttttaaaaaatatatgtgttttgagacagagtctcactctgtcgcccaagctggagtgcagtgacacgatctctgctcacggcaacctccacctcccaggttcaagcctttctcctgcctcagccccccaagtagctgggcccacaggcacctgccaccacacccagctgatttctgtatttttagtagagatggggtttcaccatgttggccaggctggtctcgaactcctgacctcaggtgatccacccgcctcagcttcccaaagtgctgggattacaggtgtaagccaccgcgcctggcctaaaataaaaactttaagttgtacttcttgcatacctgagtctgaggaatgagatttatatccactactcataaaaataattacataaaattttatatatacataattaactaggttatgtatatgtctttatatgagtgtcacaaaataatcagtgccctgaaggcaaagaaagaactaggaaggagaatgggaaggggctcagtcaagatacagccttcaggggaggcatctcttaagaagtcttcatagcatttctcctttccaatcagacctctgcggcaaacatcctccaccagatcctcggccaggccaagaagcttccaagcttgatcctcctcttaatatttattggagctggaggtcctggagcagcactgtatgtcttgcatctggcactgttcgatcagatgttagtaggggcagaaagaataacccaaaaaccctgagacaaactgggtgccaatgatcagtacaagttcaactcggtgaatgtggattacagcaaactgaagcaagaaggcccagatttctaaatgaaatgtttcactctaaagctgcttagaatgaagctcttccaggagccatccgcacaatttcccacttaaccaggaaacatttctcctctaaaatacatgaaatcatcttgacgtattattttggagattacactaattaatacatatccgagactcgaaaaaaactaaaaaagaaggtttcataaacagaagacaattcaagggagttcctgtgatcctaaagggaggaaggatttttgccaaagggtgagagaacagagagatgaaagctatggaaaggacaacagcgcaatttaaagcttgagaaaccaaaggtaaatgagaatggcaaccacaacaaaaactaaacctgagattgaaggggaactgagtcttcagaggaaagaaagcaaaggaaacatcgtttgaaaggttaaggatataggtagcttgcaactattctcaactgggcttcctcatccgaacagggttccttattcctcatctgacccagagtacatgacataattcgagtgattatttcttaattcccataagaatggcaaattggccgggcacagtggctcacatttgtaatcccatcactttgggaggctgaggtgggcagatcgcttgaggccaggagtttgaaaccagcctggccaacatggcaaaaccctgtctctactaaaaatacaaaaattagccaggtgtggtggtaggcgcctgtaatcccagctacccgggaggctgaagcaagagaatcccttgaacccaggaggcggaggctgcagtgagatgagattgtgccactgcactccaacctgggtgacagaacaagaccctgtctcaaaaaaaaaaaaaaaaaaaaaaaaggcaaatctagaatccagaaggatggcactgatctagatgcatggagggtgaagttgatcaattccatgcaatagatgacatcgggcactggggcttagaatccagattttaaaaggcctgctgttaagatgtctgtttgataaaaaatcataataccagaaaaccagaatcagcaactaaaatttaaaataaaaatagagatctcacccaggggacttttaagcttcactgaggcaatgtggtatgattctggagtggagtgaaagccttttctgacccagatatcctgtcattagtgttcacagccaacacggtctcagttgtgcctacctggcttgcagcattgggctctgccccccggcctctgttatttcgggaccctatcatccccattgctggcagcaagcccagcgctgtaacagcatctcctgccatcagcctgccctttggaatgctgggcggcaactccagggcttctctgtgatgctggtgccctcctcaccaggccatgacttagcacgccggtaaacggagtatgctctgggccctcctagggaacactgtggggggtggattttctggcctctatagtctaaccagtttggcatgcccactgctctggacatcctgattccttccttcaccatttgctgtggcagttcttccaattctacctcacttaacgtgggtcaatacttttccaggcctctaagaggcaacctcttagaggttgtgatgtagtagtatgttggcgccatctcccggggtcctcgtcagggtgtaaattccgtaccgtaaaagaaagttctcccttttccaatttgtattttgtttcctttggttcagcaccctcaagatccagtcccgtacatattcccccagttcctgatggttcacattgaccaggcctacaactacttttttttcttagcaggtttgttttcttagcgggcccagcacttctgtggctgggttatgttctaacttgcccttagcttcgggtctgatggccaagagaggaggcagagctgaatcctgagcagagcacgagttttcttgcaagacacgatcctccacatgatcttcaaataagccggaggctctagcctctaacagagaggagtggatcacttctgcaggccctcttccccacttattaccggcagccttgcactcacaggaatgcctttcttcacaggcttccattccaaagatcttattatcgaaaccgcaaatatgtcgcataccaacgtctgagcccttttaattactgtcattgcctcctccctgacagctgtctacagcacccgaattattttctttgcactgttaggacaacctcacttcacggctgtaattgtcatcaacaaaaacaaccccttcctaatcaattcaatcaaatgcctaacaattggtagtatttttgctggatttttaatctccaacaatattattccaatatcagttccccaaatgactatgctccttcacctaaaactcacaaccctcagcgtaactattttaggcttctcactagcaatagaacttaaccttgtaactaacaacctcaaactcaagcacccatcacaaatatttaatttctccaatatattaggattttacccaatcacaatacaccacacaacaccacactcaaatttccatgcaagacaaaacctaacctctcttctactagaactgatttgattagaaaaatcaacaccaaaaaatactgcccaggttcaaatgatagcctccaccattgtatctaaccagaaagatctaattatgctctactttttctccttccttatcccatctctcctaactctattcttaattatttaaccctattccctcacataatctcaatcacaataaagatactaacagagatcaaccagcaaccaccacccaccaacacccataactgcacaaggcagctacatccatagaatcctcacaaagtaattctatttccccaacctcaaaagtcacccagttttccatatttttaaaatcagttacaattcccacctcatcataatcaattaaccacataattatcaccaactctaacagcaaccctaatagtgaggcatcccaaataacaacactgaccctcaggtctcaggatactcctcagtagccattgccattgtataaccaaaaaccaccatcattccccctaaataaaattttaaaactattaaaccaggccaggcacgtggcccatgcctgtaatcccagcacttagggaggctgaggcgggcggatcatgaggtcaggagttcgagaccagcctgaccaacatggtgaaaccctgtctctattaaaaatacaaaaattagccaggcatgatggcacgtgcctgtaatcccagttactcgggagactgaggcaggaaaattgcttgaacccagagggtggaggttgcagtgagctgagatcgtgccactgcactccagcctgggcaacagagcaagactccatcacaaacaaaacaaaacaaaaaaactattaaacctacaaaagccccaccacaatttaacatagtactgcaacccacacctccactagtaattaatcccaagcctccataaataggagaaggctttgaagaaaatcccataaagcctataataagaataatacttaataagaatacagtgtatgtcataattcttacatgggatataaccataactaatgacatcaaaaatcattgttgtgcttcaactctaagaactctaatgactaacatccgaaaaacacattctctattattaaccactgtttattgagccacctgcacaatcaaacatctcggcatggtaaaatctcagcttgcttctaggtatctgcctggtccttcaaatcatcacagggttttcttagctatacactacatgtcagatactctgaccgccttctcttcagtcactcacttctgctgagatgtaaattattgctgaattataattatgctacatgctaatgaggcttcgatagtctgcatctgcctgtttttacatgtaggccgaggcttatactacgggtcatttactttcctagaaacttggaatattggcagtattcttctatttgcagttatagcaacagtattaataggctccgtactttcatgaagccaaatatcattctgagatgcaacagtaattacaaatctactgttagccatcccatatattggaactgaccttgtacagtgaatctgaggtggattctcattggataaagccactttcacataattcttcacttttcatttaatcttgcctttcattattacagccctagtagccattcacctgttattcctacatgaaaagggatctattaacccctcaggaatttcatcagattctgacaaaatcccttttcacccttattacacaattaaagatattctttattacacaattaaatatattacacaatttattacacaattaaagatattctttattacacaattaaatatattattcttattacacaattaaagatattaattctacttctcttgctcttatcaattctgctgacctcctaggagaccctcacaactacaccccagcaaaccccctcagcactccaccccacatcaaaccagagtggtactctttattcgcctacgcaattctacagtccatcccaaacaaactagggttttcttgcaagacaggatcctccatatgaccttcaaataagccagaggctctagcctttaccagagaggagtgggtcacttctgcaggcccacaggtccagcgggacctgatgattcaagattttttagtgcttggaccaagtgtccccatccaaagtctcagaatcttactgcttccaaatcagcaccctgacctacatatagcagaactggctggagttgagaattaagaattcaacaatttctggaactttgctattcatataagtccttagctgtacggcccttaggcaaccggagatgagattctatttatatacagccaagttctggcttcatacttcccctcacatggttaagtaaccaaccgaggcagtcattgtctttctccaatgcatgcatagcctccaacaacagtcatctaattccaaaattcttgtatttacttaatttcccctgaaactctcaacctcctatatgtgtcacttgccagcctatccccttctaccagtttcgtgtcccagtttgccacctgtaaacatgtgaacactggcactggcatggatgcctggggcaactagcgcttcacctatgatgggggctagcgctctaccagtgatgggggccttattacagccagccaggtgcagcaacaacatcctattttagagtcagttcctaggaccacatccagtaccagctgtcacaggtggagttcactgggaaacacactctgagacaccgagatttctatacagaagttattggagagtaatcgcagaaatagcacctgtaagtgttgaaagacaaagaatttggcagatagaaaagtcgagctgagcctcagtgggtccatggagagctctggatctgggatggcccttctgagatattgcaaactgaggcatggtggacaagtcttggtacctcacaggaaccagtcattggatgtgcacggtccctagggagggagcttaatcttgggcagtgtctttctttggctaaaagcaacactgggaaagcagcacaggtgagaggtgccaggcagcggctcccccagcggctggagaatgagcagtgcctcagtcctggaggggaatccgggcagcacccacagcatccacaatgccctgcagcactgggagcagccctcacctttctgagactgtttcttgacctgcaaaataagggaacacagttggttcttgagcagtgtggcggctagggggcactcccaaaaaacctaagaacctattgttgaccagaagccttcccacagaaacagtcgattaacacatattttgtatgtggtgggtattatatcctgtatctttacaataaagtaagctagagaaaaggaaattataaagaagaaaatatacatttacgctgggcacggtggctcacgtctgtaatcccagcactttgggaggccaaggcgggtggatcgcctgaggtcaggagttcgagaccagcctggccaacatggtgaaaccccatctctactaaacgtgcaaaaattagccaggtgtggtaagcgcctgtaatcccagctactcgtgaggctgaggcaggagaatcgcttgaacccgggaagcagaagttgcaatgagttgagatcatggcactgcactccagcctgggcaacagagactctgtctcaaaaaaaaaaaaaaaaagaaaaaaatagaaaatatatatttactattcattacatggaagtagatcatcataaaggtcttcatcttcatcatcttcacattgagtaggctgaggaggaggaagaggaagacgaggagttggtcttgctgtctcgaggtagtagaggtggaagaggtggaggaggtggaaggggaggcaggcgaggcaggcacactcggggtaacatttgttggaaaaaatccgcacagcctaggcaacaatgcaaaacctctctataaacgatagaaaaattagctgggtgtggtggtgtgcacctgtagtcccagctactggagaggttgaggcaggaggatcacttcaacccggaaggtcaaggcttcagtaagccatgatcacgccactgcacaccagcgaaggtgacaaagggagatcctgtctcaaaaaaagaaaagagaaaaactccgtgtaaaagtagacccacacagttcaaactcatgttgttcaagagtcgactgaaatagctacctcaaagatgtccaaaaaagcaaatgcaaaaacaaatgcaagcaatttgtgaactgttaacaaggttattcttctcatcctaaagtctggagcaatctcatcaccatctttctattatgccccacacccacttctcgtctcaagaagtcagtattttacttttctaccaggatttagctttactgtccactttactgcttctccaaaaagttgcagtgatgatgttgagaagtgactaattcattaggtatatctttatttttcaccataaattaatttctaaaataggctctataattaccaaaactcttctagtctataattgggggttctataaaacataaaattacaggatttatagttctttaaaatggaaaagtgctctcaaaaaatgttactagttcaaaggagattcataaatgaatcatgtaattttaagcaattctcactagatggagctagttacaaataaatacttttttaatatttttcttctttatttttaattttttatttttatttattttttattttttgaggaattaacagtctttattgggctcagatcaggaggccgtgggtcttgaggacctctgtgtatttgtcaattttcttctccacgttcttctcggcctgtttccgtagcctcatgagctgtttcttcttcccgtagtggatcttggctttctctttcctcttctcctccagggtggctgtccctgcctggtacttccagccaaactcgtgagccaggcgccccagataggcaaactttcttgtaggcttcagacgcacaaccttgagggcaacaggaaccaccatccgctttttcttgtcgtagggcggtgggatgccatcaaacaccttgaggcggtccagagcggcctggcctcgcttggtcttgtggggcagcatacctcgcacggtccgccagaagatgcggctgggggcccggaagtggtaggagcctcggtaagagttggtgttcatccgcttgcggaggaaagcgaggtacttcaacttgtttctgtagaaattgccagaaatgttgatgccttcgcagcgtacgaccaccaccttccggcccagcagtacctgtttaccacgatggccgccaggcggcccaggagatggcctcgaccatcaagcaccaggacctgcacctctgccgtcttcgccagccgcttgggaaaggcttttcttctctttaatacaggaatattttaattccttgtaaggaaaatttcctggataattccatgtattttaataatcacagagatagtcttattcttactcattcattaccaaaaataaagacttcagtaacaatttatactccatagagtatacgatctcatctattttgacatccaaaaaaaaaaggcagaaagacaaaacgcaaattctgaggcagaaattaagaaaatataattcttattttttatttaatttattgtttgttccgctgtttgaatgtttatcttccaggagcctacagaagtgagggaaagtatctgcaggctaattttaaataacacgagacagagattaaacattaaatataaaaaaaaaaccttttagcttacttattaaactaggaagaattttccttaaacacatcactcaaattggtctgcaatgcatcaataaatggagaacatagatctcacctaggaaatattttatacattgtggacactacaaaaaagctcatcagaatataaaaattttcaagtcacaatcccctaagcagactaaaaacaagttagcgtttaacctgaaatcagaagtgcaaactctgtaaaaataaaaatattgccattgttctcagcaatctatgaataaatcctacaactccttaaagtcttttcaataaaatgaaccatgatctcttgacaaactccttgcttaaatggcaggtaacttttgaagctggacttctcaatctgtcaagagaagcaagctgcattggcagcattgctcgcttttgaaaatcaccttctgaacagaaggtccagcaaagaccttcaatgcaacactccctgtatatgtgcaagtctgcatgagacgtcctcccgcaggtgcaactcccagccaatgaaccagaaacagatgaaagacaaaaggggaaagtcgaggtcaaatgtttcagtttacccatgctatcccagataaaatgccaagggcttttggaataaaatggacaatatgcaaagatgaggtgaccagatgtcaataatgttgggaatttaaaatgcatgtaccacacatgaacacaattctttaaatgcagctgcaggaagttccgtttgggggtcatcctctttgaaactcccttctgggcagtactgcttgtcatttctatcatctgatacatctatacttccaaataatcctaactgatactcaaagtgatgccttgacaccctctgaggttctacaggctcttccaaatcaaagagaggtcacatcatgcatagtattatttgggggttagcatacgttttataataattatgttaaaattggtaatccctttttgggttcaatgatagctctattaattatattgtcttgttaactgaaatattccactctgtcaatgggattaatggttggagattatgatacaaccaaaaccaaagctgggcaatgggctcttggactggaatcacccattatgaactatccatctgaccaactctttaactttcttcctaaacgtcagatcaccagggcgtttcagtgcagcctgcacaattcagagagtagggtccagattaaagaccttacatttttgtagaattcagaatcatttttcattcagcaagccctctatttgctcactctcttctacatgtaattgttcaactttggttgactgtcgagtcctcatggaagaattcccattctgccactgagcctctctgttagggacttgaaaatggaaggtagtgcagttctttctgaccatctgccaggcaaggagccccgggcttctaggggtaagttcgtcccttttcccaag

SEQ ID NO: 1731 - DNA, 104790 bp, Homo sapiens
tctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggt

SEQ ID NO: 1732 - DNA, 158264 bp, Homo sapiens
aacttgtgagccttggatttcaactatttttgtattggtctcatctcctctatgactttggacacctgctggtggcaaggccaatgtcagactcacctatctttctgttatgtttaaaatttaccatgtgtactatacttgacttaactaagtctgaagataatatctttttccttcctccaaatgatacaatccatggatctttgaatgcttgaattctgatcacagcctcccacatgatatactaatgttgcccagtattaaaatactgggctaaagctccacctttgtatttaacctgtaaatttgctctttatgtcatcatcttcatgactgtcatgattttgtacagttaatactggtttagatctacccatatgcttacaaatttcttggcttatatttctttcttccagctctttcctcccttttagatttattttgtttttccttcctttgtggttccttcagtgagggtctcttagtagtaaacatttttagtctttgaaaatgtctttatttggccttatatttgtctctgctttcagcagtctgtgatgtttctaggcatacatttccttggttttagtctgtttgaggttcactgagcaactttaatctctaaattgatacctttcaccaaacttggaaagtttttactattatttctagaattgttgttcagccccaccatgctctttctcttcttttaggactctcacgacacaaatgttacaccttttgttatggtctcaggtcacaagatacttttggttttgaatcatttttctctctgttcagagtggataatttttattgatctgttttcaagttcactgattctttcctttggcatctccattttactatggagcctacccaagcttatatttttcagttctaaagctttccacggtttttctgtatgtcttctatttctttgctgagactatttctgttatttcaagagtgttcaccgtggctttttggaacactttgcacagtaaccgctttaaagtttttattacataattccaatctctttccccttgacttcagggcatgttcattttcttcccatgtgagttgaaatgttcctggtcctttgcatgctgagtgattatggattgaatcatagacattatgaatatgatattatgtgactgtgggtcttccaagagtgtcctggtaattttagcaggcaattgacctatttaccttcaggctgccaatcctgtcagccgtccgcgggttgtgattccaatgccagttcttggttcgaagcctctgctattgtgcatttgggccaccagccagcctgggacctggatagtagtccatcctgtagttcagttctcattgtctatgacgtgctggtcagggtcagacctgggtatgtaatgagctcgggagttcataaacacctttataggatcactttcctcctctctgccacctccctggtactttacagttccctggggctccccttcttcagtggccagaaagctggggcttttgttgctccacagtgccaggcacttctgtgactgtccccacatctggtgctaagtggcaagcggcagagaagaaataaagcaatgggaattttcctcatcctcttgggcccacagtgactgcaaatggagaggagggcttccctccctcagttttgttttctgcaggttcccatggggcctgcttggaggctgaggcttgagagaccgagagaaaaagaaacgagggatttcttcacttcctttgagcattgtgaagtgtttctggctccttgggtgttacctagagggattctctcagagctctctctgtatcccggtgcatacacctccgtttctggttgtgtggcttgcaggctgtggatcccaggagatattacaacccatgccctggggggttattgggaccagtgatgccctccaacccctagtaggtggagtgtcagcaaactttttgtttttggtccctagagatttctcttactctcctgcaagctcagctatgcatatatataatattttatctagtatatcaaggtgtttagagtaagaaggttgttatcttccatattgctgaatttggaagtcaggagctatagtccaagtgagaagtactaagtggccatcacctacacagaggccacctggggaaatggtaagagctgcaccacagggcccctcagatgtgggtgctgggtgctgctttgccattcacccagtcatgtggagggaggcagggcactgaggcaaagcttactggtctcatcatctgtgaaactttcttctactattttggttcacatgccctcttttctcttctgtctgttccatttttggaatttacttggatttattctctatgtttcttaatttctcttccatatttcccatttctttgtctactttggaagaatttctgggctgattcacttttaacgaattcaccctttagttgtggttattctgctattcaacccacctattgaattttcatttaactttttgtttttctaatgcagaaggtactctatatttttctcttctggatgatgttgtggtatcttgatagttatttcattattctgtggcgatattgcctgaccagtgcctgtattgatttatttattgatttatatataacttcaaattttgaatttctaagcactttaggaactgaactcaatatcttttaagaaaaagtttctggggattcaatagtactttctctaaagttttgttcagattttattgttaactccatccttggatggtgggttttcttttggttttgcttgcttgaaacagggtctggatctgtcacccaggctggactgcagtggcaggatcatgactcacggcggccttaacctcccaggctcgtgatcctcccacctcagcctcccagctggtactacaggcacatgtcaccatgcctggctaattttgcatttttttgtagagatggggatcaccatgttgcacagtctggtcttgaactcctgggctcaagcaatactgtgcctctgcctccaaaagtgctgggataataggtgtgagccactgtgcccggctggatgctgggtgttgtgtttcttgaacgtttcctttcatctgtagtgctggttttcctaaatgtatatcgatccttggtagtgacttctggcatttttatactagaatttcttggctggccctgtgtgaaagcaacacccgtgactgcagatgaatctttaggattcacagtcaaatgggtgaacatccaccagatccacgatgaggatatgcagctgatatgggatggtgagtctgggccttgcacctgggttctgggtgacactagggggcggggtgagagagaatgggggatgaagacatttcttaagaacatggttcatcattttatttttaccattatcaatgtcatatagaaaagtggaaaatggagaaaagtatttggaacgaataaattatacattgtcccactagtgagataaaaagactgctaatattttggggatctccccttccagtccatgaacatttataatgtgctataggtgcttacagtgaaatggtgttcaagacagacacatccctgctcttcataaacttgcagttttttgttttttattgcactgaactcttctaacattaatttatatttacagaagaaaatgcacaaatacagtgtctttacaaaagagtagaaatgtgaccaacaagggtaaagttgcactcaccccactccacctcgctcctctgccctcctcccctgcctgtttgctgtagagtcctgtgttctttgtctttatatacattctataaatacacatatacaaatataatttttatttattagtagtatttcaatagttttgggggaacaggctgtttgcttagatggatacattctttagtggtgatttctgagattttggtgcactcatcacccaagcagtgtacactgcattgaatgtatagtcttttatccctcaccaccctcccaccccttcccaagtctccagagttcagtgtatctttcttatgcctttgcatcctcatagcttagctcccacttataagtgagaacatatggtgtttggttttccattcctgagttacttcacttagaataatggtctccaactgcatccaggttgctgcaaatgccattattttgttacttttttatggctgagtagtattttatgttgtgtgtgtgtatatatatatatacaccacaattcctttactcactcgttggttgatggacatttaggctggttccatatttttgcaattgtgaattgtgctgctataaacacatgtgtgcaagtgtctttttcatataatgacttcttttgggaaggcagatacccagtagtgggattgctgggtcaaacggtaattctacttttagttctttaaggaacctccgtaaggttttccatcatggttgtactagtttacatttccaccggcagtgtaaaagtgtttcctttccaccacatccacaccaacatctattgttttttgatttttaaattttggacattcttgcagaaggaaggtggtatctgtggttttgatttgcatttccctgatagtgatattgagcattttctcacatgtttgatggccatttgtacatcttcttttgagaattgtctattcatgtccttagccctctttttgatggaattgtttttttcttgctggtttgagttcctggtagattctacatattagtcctttgttggatgcatagtttgcaaatattttcttccactctgtgggttgtttactctgctgattatttctttttctgtgcagaaggttttttagtttaattaagtctcatctatttatatttgtttttgttgtatttgcttttaagtttttggtgatgaaccctttgcctaggccaatgtctggaagaattcttctgttagcttccagaatttttatggtttcaggtcttagatataagtctttgatccatcttgagttgatttttgtgtaaggtgagagatgaggatccagtttcattcttctacatgcggcttgccaattatctcagcaccatttattggttagggtgtcctttccccactttatgttgttgtttactttgttgaagatcagttggctgtatttggctttatttctgggttttattctgttccattggtctatgcacctgtttttatactagtatcatgcttttttggtaactatagccttatagtatagtttgatgttgggtaatgtgatatttccagatttgttgtttttgtttagtcttgctttgactatgcaggctctttttttgttccatatgaactttaggattgttttctctagttctgtgaagaatgatgctggtatttggatggagaaaataatttggatggagcattgaatttatagattgcttttggaagtatggtcattttcacaatatttattctacctatgcatgagcatgggatgcgtttccatttgtttgtgtcatctatgatttttttcaggggtgttttgtagtttgcattgcagagatctttcacctctttgattaggtatattcctaagttttttttttaagctgttgtaaaaggggttgagttcttgatttgattctcagcttagtcactgttggtgtatagcagtgctactgatttgtgtacattgatcttgtattctgaaacttcactgaattcatttatcagataaaggagctttttggatgagtctttagggttttctaggtatacgatcatatcatcaacaaacagcaacagtttgacttcctctttaccaattgggatgccctttatttcattctcttgtctcattgctctggctaggacttccagtactaagctgaatagaagtggtaaaagtgggcatccttatattgctccagttctcaaaggaaatgctttccacttttccctgttcagtataatgttggctatgggtctgtcatagatggcttctattaccttaagatttgtcccttccatgctaattttgctgagggtcttaataataaagaaatgctggatttgtatcaaatgctttttctgtgtctattgagatgatcacatgatttttgcttttacttctgtttatgtggtgtatcacatttattaactcatatatttttcaggggttggggacagagtcttgctctgtcacccagtctggagtataatggcatgatcttggctcattgcaacctccacctcccgggttcaaaggatattcatacctcagcctcacaagtagcagggatttcaggtgtgtgtcaccatgcccaactaatttatttgtattttttagtagagtcagggttttgccatgttggccaggctggtctcaaactcctggccttaagtgatccaaccaccatggcttcccaatgtgctagattacaggtgtaagccactgtgcccggcctgacttgtgtatgttaaaccaaccctgaatccctggtatggagcccacttgatcacggtgtattatctttttgatacgctgttgaatttggttagctagtattttgttgaggatttttgcattgatgttcataagggatatttataaatatgtgtatgaaaagtttcagacacttgtttgtttcccactgaaatgttggttccaacagatctactgcattcccagtagtgttccgtggtattgatattctagagtttagaaatcatttcccatgtagatgaacactgaagttgttcccaggatgttactattcaagcaatactagcatgaacttttttttattgttatattaaattctggggcgcatgtgcaggatgtgtaagtttgttaaataggtaaatgtgtgccatggtggtttgctgcacctatcaacccatcatctaggtattaagcccagcatgcattagttatttttcctgatgctgttcctcccactgtccccagaacgtttttaaatatgcctccttatacacaattgtgaagggttctccgggctaggtaccaaaaagtagacttttatcatgcattctaaacttaacagagtgtgaagtaaaaccacattataaccttctgtcctgtcttgacactcattccaatcactgtccttcccaattacaggcttttgatggccattattttagttctatctagcccagaaattagaggctgtattagttcgttctcacacggctatgaagagactgggtaatttattcaggaaagaggtttaattgactcacagttctgcatggctggggaggcaggaaacttacaatcatgatggaaggtgaagaggaagcaaggcgccttcttcgcaaggcagcaggtggaagaattgctagcaagagcagggaaatctcccttataaaaccttgagacctcgtgagaactcactatcatgaggacggcatggaggaaaccacccccatgatccaattacctccacctgatctctcccttgacacctggcattagggggattacaattcaagatgagattttgggtggggacacagccaaaccattatcagaggctatgactgccatcattttatacaaactgtttagatttacatacattcttacatttcttttgcatgtctgaccttcctttgaggcccatccacttctcttcattgcagagtcagcttttaaaagtttctttagtgctcttaagtgagctcccttagtttttgtttgaaatgttatttactgtcattcttgaaagaccactgtactgatgactcaattctagagtgacaattgttttcccttggcactttgaagatattatatagtatagttttctggctttctttgtcggtgtgaagaagcctggggtcattctaatttttgttcctttgtaggtgatcttttttctctaggtggtttaagattttccttttttttcgtttatttattcacttttattttaagttcattggtgcatgtgtaagcttgttatctaggtgaacatgtgtcatgggggttggttgtacagattatttcatcacccaggtactaagcctactactcaatagttattcttcctggtcctctttctccttccaccctccaccacttgataggccccagtgtgtgttgttcccctctatgtgtccatgtgttctcattatttagctcccacttataagtgagatcaagcagtatttggttttctgttcctgtgttagtttgctaaatataatcgacactagttccatccatgtccctgaaaaatacatgatcttgtttttttattttatggctgcaaagattttcagttgtgttttcagtgctctacagaagtatagagaatggtatcacaaactcccatgtgcccattccccagccacagcaactcacgccacccgtgtttttctgtctccttacttacactgtctccctgccaggattattgtgaatcagatcccagacttcttattgtttcatctataactattttggtgcatatttctaaaatcatattattttaaaattgaaacatttttaaaaattgtagtgggcaaattatagagtaaagtgcaagctaggcacaaatttctaagataaaagagatcccaagattgtgtagaatagagaggccctgagcaattcatccagacaccagagattgccagctcactctcatttacccatcctgacatccaaccctacccattacagaggctaagccatttgtccaaggtcacatagagaatgactgggagaatcagtagaattccaattcagggctcttcccacagcccgtgttccctacattgttcttgaatcttcccaaagtcctgagaaagaaaagaggtagggagtgggagttgtggctacggagaaagaggagttgatatttccaatgtatatcagaagcaaacttgaactcacctttcacagccttccttagcaccaacagccaaacacaaatacctgtgttttatacagaatgcacttctgccaactcccacccttgctgtttacacaaatttgtttcttaattattgaaaacctcctgtgtgccaggtgattctctaagccctggggatgctgcactgaattaagctgatgtccctggcttcatgcaacttacattctagtcaaggagaggaagcaagccctcaacaagggcatacatgtcagggaagcaccatggagaaaataaagcaaggggaggggctgagcagtgtatgagggtgaggtgacagaaatgtcctctccaataaggaggcacttcaccagagacccctgttaaactaaaggacgcaagaaggtcagaatttaccttaaatagagttgatttaggcacaaacgttgaggacaggcctgtgtgggaagcccagattccacagaatggaagtctgtattccaaagtgaagtttgggatcctttatacagaggaagcttgggaaagcctagcagaatttcaacatctttctgtgtaaggtttaatgcatcatttaaatgatctaattagtccaggtggtctttttctttgtggaaaggtagatttaacattcctcactgaagatttaacagtcttggcatctcgggtgtcatctggtcttagcaaggtacacgacaataaaggagtcagttaacctataacaaagatctgggttcggtagtgggcaaggcctggtctctggtctctcctactcattcacagaagaggaacaatggggaagagagttctcctttaatctgagaagcagaattggaaaccggtggtgcgactcagtcttgggtcttaatatccttctgggtgtaataaacttggagggtgctgaaacagtattttctttgacaccttgaaggaagggagaaagggagctctatggctctctaagggaagagtccttggcatgttcaaggatcaagaagccagtatgatgatcatggagggagcagaaggaagagcaggagatgagatgagagaagagtagtggggccagaatcctcttgggtcttctaggcacagtcaagattgagggttttactttgagtgggatgggagctcactgaagcacagtttttaacttctctaagaaggaagagaggggtgaacagtgcttgtgatagggtgtgaggatagtcagtccattctaggaccaagcagaaataggttataaattacttgttcctgttttccatgtaacaatttccttcctttgatgtggagacaaaacagaaagaatgtttgctttggtagatcatcttcagcatccctctgtgcttaaggaggcgtatgcacattggaatgtcctgacatgagtgtccagggtgctgttgttgccttttttgttgcaaactcttgtccttgaggtgtttgccttctgatttgaacctaatcagggtattgaatactgtggctgctaagagatcatattttgcataagctgcttttgagagaacggtgaatgattgactcctcagagaaaatgcctagcagacctctgcagatggagaattccttatttcccatatgtgtcattcccagttctttgtctagagagtcaagtattgaactaaacgatatttcagggtcctctctctcctcctagtcagtggtgaaatggaaaagcaggggctccagaaccagccagatcagtttccataccagctctatgagtcaggaccctgcagacttgggcacgtgacttcatctctaggcctttcttcatctgtgtcatgagagtaacagcgctgatcttgaacatcgttgtcattattgaataaaaatgcacataatgtgctgagctttgctgggcacatagatgtcccacaagacaatttcattgccttgattcgggtgtctaggtgcgggcgggggatgatatggagggtggcaggtagggagcgtccttatagctgtagtcagggaaaactgaaatagtcagttgcttctccgagagcagccgtgccacctctgaagcacgagtaactggcagggctgtctgtcccctttgggctgcaacctggcttcaattctgaccctgacattgtgtgcttctgaagccttctcctcttgttttgacacctgaagtccccctgtatatcctagacttctcagtctaccagagcattcaccttactttcttcatcccaccctgcctttgatgatgcctaagtccccgagacaggaggaagtcttccccagaaaggtactatagcagcacttatacccatgtttaatgtcccagaaaccttgtgttcaagtaatgctttctcaagggtcttatgtcttttctgttagagcttcagccccgttcttgtgttctgttctaagtgaatgaaacgaacattatgctgtagacattgatgggtttgaaggcctaaaatgaacaagttttgttgaacaaagattctttctcgtctttatccttttcatgctaaggaatttcctgtctccatttcttttgttcccaccctactctacaccctcatgattccctaacgggaccactttaacagcctcccaacaccctcttcctcttctctatacgattctgctcttagcagccagattctctttagaacatgcatgctggaacatgccactccttgctttaaacccctcagcagctccctactgctcttagggtctcagtctgctcccatattctcactcacccgactcagaatgtcctgacctctgaggcctctcacccttagcctacaccacttcctgcccctctgggaactgcagtcacactggtactttctatgacacaaagagaccccccacacacaccacgtggaagtcttctgcccttgccctgtgtgttcgtaggctggctttcaacttcgggtctgagctggagcatcaccttctcagagaaacatcccctgatgggcctaagggctcctcccccgtcatttggtctcagaactcccctcagcttcctcccttttacttaatttgcatttaactgctgatttgtctttcccccaccagaatgctaacttctcaagggtgggaatctgtttttcttgtcctcccctggatccccagcccctagcagtgcctggtaatagtaagtcctcaatatatagttgctgaatgaatttatgattactttttataacactgaaagattgcaaagaatctaattattcagaaatagggtattcaccaaaaaaattatgatagaattagtcagatgtggtggctcacacctatagtcccaatgactcaggaggctgaggtaggaggatcacctgagcccagaaggttgaggctgcagtgagatatgatcacgccattatactttagcctgggtgactggttgaggccctgtttttttttttttaaaaaagttatggtagaatcatgtgattgcctgttatgctgtatagaggaatatattatggaatgaaaaaaattactagtcctattttgtgaaaaaaaaatctatcaacattcggttgttttttgttgttgtttgtttgtttgtttttttggttgctgttttaaaaaaagactgcaaggacagctaccaaatattagcagtgttatctctggggtgagtgatttttcttcttttccttaaaaaaaattgtgtattaagtatttcctacagtgaaacaagtattgcttttatagtggaaacatgattctaagcagagctgtgcaatgctgacctggcatggggtgggaagaagggggttagggaggcggtgcttagggtccagagtctgagttggcctcattctggtttcagctctggaaggagtgaagaatgagtcactggagcccatccagtccctcatggatgacatactgagggctcaggaagatgcccccttgcaacctgcctcagcttccaggctgagtcacctaagcagcttctttcagaaagcctttcacaggcacactcaggaagaagtacatcttcaattgaacaagaaataatatgaataaaaaatgtaaagaataaaaaatgcactgccacactggtggggcaggagggtgaaagtcgtgcccctcacaataggtaatgtctataaaaggacaaccgaggccatcaccaagtccacctacagaaggcgggtctgtctcaaccccagctgtcagtcactgtgaacctttagaactggggctgaagcttcttccagttgcttgctcagatgtcagtgagaccgctccacaacagataaggggagctgtgtgtcaggaaagtcccagccaccaggacaagctgcactccaggcagacgtttctgttcttgtgcaaagaacagcgcaatccattcaagttcacaggggcaggtggcacttgaaaatctcagggtcaacttgcagggcagaagttagcagggaagtcttcctgggggagtgggagagcccagcagagtttaggaggagggaagggcgatatcggggcaatcctctgagtctctctttcctcttcaggaactgttcaggaagaccctgcagtctctctgctggctcatgggagctcccagaactgaagcaacatacagatccaggccactctaagctctgcctgcattttcacagggcacattcttgtgtatatgtgtgtgtgtgtgtgtttggtgcatgtgtgtctgtgtgtgtgttctcttcttaataaaaccagcaatcactggactaggtagggcccactctaatccactgagctccccttaccttggtaacatctgcaaagaccctattttcaaacaaggtcacattccgggttctgagtggacatgaactttttcaacccagtacatctgggaacaggcagtcaagggtagaagagatcaacctgaggatgaggtttggatgcagagttttgagagaagggtgatcagagctagggtctaagcaacattggtctgctcccttggaggagaattttccctttttccttctgccctttagccagtgctgcagccacctcctctctcatagctggcatttaaaagccaaatggatgccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggttatataaactctgtgaatgttgcttaacttagtgacaagaggggaaaacaacctgacctgcttcactgctactcctgccacacgttaatcctcactatttgcccctaagtccctgtctgcccttagtatcctccacactgtgccccgccattaccctagagccacttgtaactcttacagcagttttctctgtgatacatcttgagcttcagttttcttttataatcatgtaatacataaagattgaattgagaaatcatcataaacagaagatattgtccaatggaaatttctgggagatggaatgttctatgttttatgtctatgctctccaattcagtggccactagtcacatgtgacagcttgaaatgtggctaacgcaactgaatatttagttttaattaaaacttaaataaccacatgtggtcacggctactgtattggctggtgcaaaacaatatgttatcttatgatgtaagaaagacagtagtcagttgtcttaaactgttacataaaaccacgtgtcataacatgcattaaaagaattatagatgcatggaagaattcataaaatcagcaaaataatttaacaccttctttttcccttaccttctacacatttatattttacttctttttagccatctatcccattctaatatctttctatgaatacattattctattgtgtacaatttcaacttacaaggcacagacattcactttgaattcagagtccacaactaagatattttctggtgcatccacagtcatttgaaatttgggtaacactgccagtaaaaaaaatatatatatattatattataatgtgtatattatatattattaacataaatacatattaacataaatacattcatacaaaacaattgtttctcctttacaaaccatcaacctttgcttatgtttgccattaataaacagtgtgaggaggacgttgaagtgcctaagactggattttggaattggatagaaaaatgcatattttgaattccaaattcatcacttctcaggtgttgaacttgggaaagtgtttctcaatatcttcatctttaaaatagtaataaagatactacaatagaaattttatgaagattttaggagaaaatatgaagggactaatggctaacatatgactaatgttaattccattcttctcataagaagtgctttacatcccagaaactatcatataaaatagaatccagatactacaaaaggaagatagatagcctaggttaacagagaattgcaggaagattatgggctgaactaggagataaaaatcacagtagatggagaaccctaaaatagtaacagaggacaaggaaagaggaaaggaagagatactcacttgaaaattcattatttaataatcctgcccttgcaaaattggaaagattttataatttttttattaataggtaatattttcattgctattatttaccatattcttccacagagaaggagtgatatgttttcttctcattgagcatctccacggtgatttcataccatccgaggatgggctctgagattaactggaaggagagttgtagaatccctcccacagactcctcattcacccactgttgtattcgattgccttctggatcctgagaataagaaagtgtatttttgcatgctggatgtttttattcattataaagtttcagcaaggtgtttcctacttaggtttccaactgacttaggattcaaaacatgagtgtgtcctcacatcacccaaggagaattggttactctcctatctgaggtcacatagatgcatattacagtacttagtatattttagagctagctgtgatttttttacatttattttctgtgtcaatctctgatttcttaaaggcgagccatattttatccccagtgcataaaacattaagtgtacatttatatacattcaacaactaaacattaaattaaatacaatcatacttgcccgttgtctatattattattgtctgtattaatgggtgcatgctaatatgaatcacatggtggtgggggtggaaacctatttctgtcctcttgaggctgtctacatgaaattaataattctgcgacaatttaaatagacaatcttccctgtgagctgccttttgattttgaggtttagagagatgttcaaaaaatgagaaaacaattcttcaactattagttatcttacctgaagggtgatcactggatactgaaataaaaataaaaataatgttaatatatgaactcaaggtttttttttctagatgagtgaagaggttaattataaatctattattaagcaaagaaacataaacacatttaggacaacccaaacaaatactgatttctgactgaaagtttgaatatctattgattatattgaaactcatctgcctagttttcaagaattttcatttacttctctctctttcacaacatacaccctgcagtctcagtaagcaaccctgcccttgggtctctccaacataataaaaatgccctcttagatgaatcataacttccttatcaacaaattcgtggtcagtcttcactctgacagttgcaatgttttacactgctggttgcctctttttgaaatgcttcaattttgatttctgtatctagcactaattttttttgtcttagattattggccattcctatactccaccatttccttatcagacaagtaaataaacgtagacatttgcccaagtttcccttgcagagtttcctctccttcttccttctccttccacctctctgtatctcctctcagttctctccatgtttaccactcttgccccctctaaacctatagtcaacagtttgactttcatctcttagtgttttctctcaggaccttaaaactaacaagttgaaattaaagactcctaggccagaagccctcatgtgaataggctgatgagaattttaaaaatgagtacatagggtcctttgcccactccccaagttgctaagtgctccttcccactaattgcagcattcattcactaataaaacgtaatgtgtctggagataagaacaggattcataaaccttgtccagaattcttggaactgagaaatataacagttgaattaagggcctacttgttattctaaattcatggaattgaatcttgatgaaatattgagatggtattgaagaaagctactgctgcaacattaactcaagcattaagagaggtagagcttctcatgagatttcctcataggaagaaaatgaagaatatattacccaaaggtgccatgggaagacgttaaccatttggatgagattctaataatgagaaatgaacctagagtactatccctttttgtttgctatttgtaatacttccaatgcagatggcttcaactgtgttcaacaaatttagtttttattacttaatttgtcttttttttttagatttttttttaaactcagcttggtctatttcaaaaaactagtgaacaagaacctagtaaaatcacattttcattgttctaagctgcttgatttttctctaaaaacaattattaaaatgaggctgattctgctgtagtcactaatgactgtctgcactaaatcttgtataaaccagccaagaaccaatacaacaactccttcatgtccccttctggttcatactatctctccctgtccatacacagggcctctttttagaggactagtagttccaggtcttaagataagtttaaagaaagatctgaaacttcttgatgcaaatgaaactttctggaaaaagtatgtttgaatattctacaaaacactgacttaaaggaaaagaaaggcaccatcagcaatgaaattgcagaaaatgaaagaaaagaccgatgtaagatttgggcagaagaaactaggtatatgctctatatcttggctcatttgataatgagcccagttgcatcattactatatttttattatgtagtcaaatttattatgaatgcccaaatctcataggccagccatgcattgaatctatttatctaaatggaatactgaaccagataatgtccagcaattagaaacactggcttgcaaagataaaaccacataatctcttagctgccatcatttttggaaatgctacatcaatttccatctctatacataagcacatgcagtttgttgtgccatggaaactccttgccataaacatttggtacaaatgatcttcttatctatgacccatatttgagggaacagtccattaatcctgttcttatgcaaatgtagttattactaaagcagggagttggataatcatatttggcctaattgacaataataagtcaacattggggggtgagaactaataagggagttatgataatgctgcagctgctttgattttcaagaagacctttacttccccatggtgcttccaatcaaggatgattgtcaaaggattgcagtagaaattctcactgccttggttaaatagaggagttgcattcttagaaatagaagcttcaaccatgaaccaaggagaacaggaaccacatgctatcttacggaagtgatttcggatttagattactacaaggtctttggagcactaaaaattagattcctgctctggaaattaaaattaagcaacagtctagtgaatgtagcataactatagaagatggggaaaggaggtggattaaaagtgacgatgtcttaaggatgaagtacaatttggagggaggaaaaggcactaacagagaaaccatctgcacagcttctgtaagcttcagaagcttcttcgtaactgcgctcagttgatagattgatctgagagaccacaaaagaatgcttagttctaacaggtttctaaactacatgaaatgaaatttgtcaggtatcctgttgtaaagactgaagtccaggtcataattcgttgtcttttgacagttttcactgttgatcgccttggttctcagattgtcgctagctagattgtagtcttctgctgaaata

SEQ ID NO: 1733 - DNA, 139247 bp, Homo sapiens
gccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggt

SEQ ID NO: 1734 - DNA, 144270 bp, Homo sapiens
gccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggttatataaactctgtgaatgttgcttaacttagtgacaagaggggaaaacaacctgacctgcttcactgctactcctgccacacgttaatcctcactatttgcccctaagtccctgtctgcccttagtatcctccacactgtgccccgccattaccctagagccacttgtaactcttacagcagttttctctgtgatacatcttgagcttcagttttcttttataatcatgtaatacataaagattgaattgagaaatcatcataaacagaagatattgtccaatggaaatttctgggagatggaatgttctatgttttatgtctatgctctccaattcagtggccactagtcacatgtgacagcttgaaatgtggctaacgcaactgaatatttagttttaattaaaacttaaataaccacatgtggtcacggctactgtattggctggtgcaaaacaatatgttatcttatgatgtaagaaagacagtagtcagttgtcttaaactgttacataaaaccacgtgtcataacatgcattaaaagaattatagatgcatggaagaattcataaaatcagcaaaataatttaacaccttctttttcccttaccttctacacatttatattttacttctttttagccatctatcccattctaatatctttctatgaatacattattctattgtgtacaatttcaacttacaaggcacagacattcactttgaattcagagtccacaactaagatattttctggtgcatccacagtcatttgaaatttgggtaacactgccagtaaaaaaaatatatatatattatattataatgtgtatattatatattattaacataaatacatattaacataaatacattcatacaaaacaattgtttctcctttacaaaccatcaacctttgcttatgtttgccattaataaacagtgtgaggaggacgttgaagtgcctaagactggattttggaattggatagaaaaatgcatattttgaattccaaattcatcacttctcaggtgttgaacttgggaaagtgtttctcaatatcttcatctttaaaatagtaataaagatactacaatagaaattttatgaagattttaggagaaaatatgaagggactaatggctaacatatgactaatgttaattccattcttctcataagaagtgctttacatcccagaaactatcatataaaatagaatccagatactacaaaaggaagatagatagcctaggttaacagagaattgcaggaagattatgggctgaactaggagataaaaatcacagtagatggagaaccctaaaatagtaacagaggacaaggaaagaggaaaggaagagatactcacttgaaaattcattatttaataatcctgcccttgcaaaattggaaagattttataatttttttattaataggtaatattttcattgctattatttaccatattcttccacagagaaggagtgatatgttttcttctcattgagcatctccacggtgatttcataccatccgaggatgggctctgagattaactggaaggagagttgtagaatccctcccacagactcctcattcacccactgttgtattcgattgccttctggatcctgagaataagaaagtgtatttttgcatgctggatgtttttattcattataaagtttcagcaaggtgtttcctacttaggtttccaactgacttaggattcaaaacatgagtgtgtcctcacatcacccaaggagaattggttactctcctatctgaggtcacatagatgcatattacagtacttagtatattttagagctagctgtgatttttttacatttattttctgtgtcaatctctgatttcttaaaggcgagccatattttatccccagtgcataaaacattaagtgtacatttatatacattcaacaactaaacattaaattaaatacaatcatacttgcccgttgtctatattattattgtctgtattaatgggtgcatgctaatatgaatcacatggtggtgggggtggaaacctatttctgtcctcttgaggctgtctacatgaaattaataattctgcgacaatttaaatagacaatcttccctgtgagctgccttttgattttgaggtttagagagatgttcaaaaaatgagaaaacaattcttcaactattagttatcttacctgaagggtgatcactggatactgaaataaaaataaaaataatgttaatatatgaactcaaggtttttttttctagatgagtgaagaggttaattataaatctattattaagcaaagaaacataaacacatttaggacaacccaaacaaatactgatttctgactgaaagtttgaatatctattgattatattgaaactcatctgcctagttttcaagaattttcatttacttctctctctttcacaacatacaccctgcagtctcagtaagcaaccctgcccttgggtctctccaacataataaaaatgccctcttagatgaatcataacttccttatcaacaaattcgtggtcagtcttcactctgacagttgcaatgttttacactgctggttgcctctttttgaaatgcttcaattttgatttctgtatctagcactaattttttttgtcttagattattggccattcctatactccaccatttccttatcagacaagtaaataaacgtagacatttgcccaagtttcccttgcagagtttcctctccttcttccttctccttccacctctctgtatctcctctcagttctctccatgtttaccactcttgccccctctaaacctatagtcaacagtttgactttcatctcttagtgttttctctcaggaccttaaaactaacaagttgaaattaaagactcctaggccagaagccctcatgtgaataggctgatgagaattttaaaaatgagtacatagggtcctttgcccactccccaagttgctaagtgctccttcccactaattgcagcattcattcactaataaaacgtaatgtgtctggagataagaacaggattcataaaccttgtccagaattcttggaactgagaaatataacagttgaattaagggcctacttgttattctaaattcatggaattgaatcttgatgaaatattgagatggtattgaagaaagctactgctgcaacattaactcaagcattaagagaggtagagcttctcatgagatttcctcataggaagaaaatgaagaatatattacccaaaggtgccatgggaagacgttaaccatttggatgagattctaataatgagaaatgaacctagagtactatccctttttgtttgctatttgtaatacttccaatgcagatggcttcaactgtgttcaacaaatttagtttttattacttaatttgtcttttttttttagatttttttttaaactcagcttggtctatttcaaaaaactagtgaacaagaacctagtaaaatcacattttcattgttctaagctgcttgatttttctctaaaaacaattattaaaatgaggctgattctgctgtagtcactaatgactgtctgcactaaatcttgtataaaccagccaagaaccaatacaacaactccttcatgtccccttctggttcatactatctctccctgtccatacacagggcctctttttagaggactagtagttccaggtcttaagataagtttaaagaaagatctgaaacttcttgatgcaaatgaaactttctggaaaaagtatgtttgaatattctacaaaacactgacttaaaggaaaagaaaggcaccatcagcaatgaaattgcagaaaatgaaagaaaagaccgatgtaagatttgggcagaagaaactaggtatatgctctatatcttggctcatttgataatgagcccagttgcatcattactatatttttattatgtagtcaaatttattatgaatgcccaaatctcataggccagccatgcattgaatctatttatctaaatggaatactgaaccagataatgtccagcaattagaaacactggcttgcaaagataaaaccacataatctcttagctgccatcatttttggaaatgctacatcaatttccatctctatacataagcacatgcagtttgttgtgccatggaaactccttgccataaacatttggtacaaatgatcttcttatctatgacccatatttgagggaacagtccattaatcctgttcttatgcaaatgtagttattactaaagcagggagttggataatcatatttggcctaattgacaataataagtcaacattggggggtgagaactaataagggagttatgataatgctgcagctgctttgattttcaagaagacctttacttccccatggtgcttccaatcaaggatgattgtcaaaggattgcagtagaaattctcactgccttggttaaatagaggagttgcattcttagaaatagaagcttcaaccatgaaccaaggagaacaggaaccacatgctatcttacggaagtgatttcggatttagattactacaaggtctttggagcactaaaaattagattcctgctctggaaattaaaattaagcaacagtctagtgaatgtagcataactatagaagatggggaaaggaggtggattaaaagtgacgatgtcttaaggatgaagtacaatttggagggaggaaaaggcactaacagagaaaccatctgcacagcttctgtaagcttcagaagcttcttcgtaactgcgctcagttgatagattgatctgagagaccacaaaagaatgcttagttctaacaggtttctaaactacatgaaatgaaatttgtcaggtatcctgttgtaaagactgaagtccaggtcataattcgttgtcttttgacagttttcactgttgatcgccttggttctcagattgtcgctagctagattgtagtcttctgctgaaata

SEQ ID NO: 1735 - DNA, 88155 bp, Homo sapiens
gacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacg

SEQ ID NO: 1736 - DNA, 87650 bp, Homo sapiens
aacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacg

SEQ ID NO: 1737 - DNA, 150169 bp, Homo sapiens
gacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacgggatttttaagaaccatcatcaatttcaaaacccgtgtcctcttagtgttactccaaagaatgttgaatatgaaataagaaactttctttgtcatagttttctatgtttagcatgtattcattcggaaagatatttcttaatcctgatctaccataagcagcaatatttgttaatgttttatgtgttccttcagtaaggagaaaagaacttaaatatattactttcagtttaaaggattaaaatttcttccaggactcatttcttttaccagaaatcacaaaactgttgatattatataaagtgctgtgtttgtatttgccttatttgaacttgtattttgatttgctctcacaataaatcaagtgatgaaatgatgttttttagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatcagtgtgatgagtctgatattttgctgttggtaacaaaataatcacagattattgaacaaccattctgctgaatgcctgcctaccaaaaatttcttttagaaagtaaagtttagaaattttctctttagggctgggtgtggtggctcacacctgtaatcccagcactttgggaggccgaggcgggcagatcacgaggtcaggagattgagaccatcctggctaacatggtgaaaccccgtctctactaaaaatacagaataataataataaccggcatggtgacgggcacctgtagtcccagctagtcgggagtctgaggcaggaaaatggcgggaacccgggaggcggagcttgcagtgagccgagttcgcgccactgcactccagcctgggcgacagagcgagactccgtctcaataaaaacaacacaaaaaagtaatttttctctttatatttatattttattttaaagaatttagttgataaataaaaatatactttcatgtttgacaatatgctgttttgatatatttatgctacaatgattaccacaaattaattagcacattcttcatcacctatgcttagcattgggtgtaggtgggtgtgtgagtatgtgtgtgtgtgtttgtggtgaggacacttaaaatctgctttcttgccaattttcagataaacaatacaatattattagctctaaatatcactagatctctatgtttgattccaagttcttattcatattatagctgaaagtttgtactctttgaccaatatcttaatcaaacaaaagcagcaatgataagttctaaaatgcagggatcctaaaatgacaactgatgtaatgaatcattgataatacacccctaattctcatacattaaacataaaacctcattttcacatcgattaccattttaagtttatttaaatcaatatgatgtttttacatagtcggtttggacagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaactgttgtgtccagttcataaaatgtttgtggcaagaaattagatgcaatttttcagactttatttctgttcatcactcttaaatctctcaaagctttctccacagcttctgaggctcattgttttacagtaaacggaaaacatatcattgtctctgatttcaaaattatatcactttacaaagatgtaaaaaccaagtcaagtcttaattcatgttggtaatgagatataagtaattacaatttatcaatacataaatgcaccaaaaatgatatcaatacattaatgcaccagaactgatgaaatgtagatacttctacaagatgacaatctagcacacatgataatgcaaactaatcataagaattaaaacgtaattgggtatataaatattacaacataaacatacaaaaaataaaaatacagtatcagttataacatgctcacttgcatgcactcacttgcaaacatagaaacatgatacttttgccctgatttaatgtttatagaaaaaatattgccaggaaattcaaaactatagttaaatgtgtgtgtatatatatatatttatatgtatgtgtatgtgtgtgtgtgtatgcgtgtgcgtgtgtgtgtgtgtgtttagagatagtcggggtaaaagttagggtttaattcttttgtatatatcggtatcctctgatttttctacctttaacatatatcactttggaaacaaaagtacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttaccatataaaatcaggtggcttatatactcaggctgtctccttgttagtgatcctgatttagataaattgcttgagttgaggaaagccagatttcaaaaatctaaaggacatttgttataattagcaacttatgttgatagaaatgttaacacttaggaatatatgtttattcctaaattgttttagtacatttgggccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttactttctgatattatcaccatagtgatgaggatgtaacatacaaattttgaaagggtactactatgcacaccatagcacagcatagggataaacaaatatgttccatgtaaatggaaaccaaaagcaagcaggggggctatactaacattaactaaaattgaatttcaagtcaaatctgtaaaaagaaacaaggaaggccattatacagtaataaaggagtcaattcacaaatagattataactattgcaaatatatatgcactcaacatgggagcaatgaaacttataaagcaagcattaatacatctaaaggaagaaataaacaatgcagtaatagtaggggacttcaataacccacattcaacaatggatagacagtctatacagaaatcaataaaaacattggacttgagctctatgttagaccaaatggacctatcagacctatatagaacattccatttgacaacagtagaataaacattcttctcaagcacacaaggtataatctccaatatagatcatatgttgggccacaaaacaagtcttaaaaaattttaaaaagattgaaattacataaatttttttaacattgtcatatgaaattagaaaacaatagcagaagaaatgttaggaaattcacaaatacatggaaattaaacaacatgatcctgaacaaccaatggggcaatgaagaaattcaaagggaaatttaaaaatatcttgagaaaaacaaaaatggaaaagcaacatactaaaaaacatatggtatgcaacaaaagcagtataaagggatgtctagagatatgaatgactccatgaagatcctaataaagcaagtaactttgtatctcaggaaactagaaaatgaagaaaaaaattaacccaaagctactggaaagaaaaaaatagtaaggtacagaacagaagtaaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaacagaagagaccgctataaacagttatatgccaacatataactgttggataacctaatagaaacagatacattcatagacatctacaacctaccatgattactgaaacataatgaaatacaaaattaatacagaacagtaatgagtaagaaaaatgaacaagtaataaaaagtctctcatcaaaaacaaaacaaaacaaaaaaaaaactcgtggcttcatgacagatggaatcctaccaaacatttaaagaatcaatcctaatccttcccaaattctgtcaaaaatttaagagtgaactctcagttttattatatgagggcaaaaatcgtactgacaccaaagccacacatggatactaaaaaaaacaattagaggtcaatattcttcatgaatatagaggtaaaaatgctcaacaaaatacctccaaagtgaacacaacacattaaaagaatcactcgccataatgaaaggggatgtatatctgggatgtaaagatagtatacatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaagctcacatttaacattatactcaagagtgaaaagttgaaacatttttgtctatgatcagaaaaaaaaaaaaaaaacaaggaggctcactctcaccacttctgttcaacatagtgctggaaatcctggctagagctattaggcatggaaattggaaaagaagacagttgtctctgtttgcagatgacatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtacactgaaaactataaaatattgatgaaagaattgaagaaaacacaaataaatgaaaagatgtcctgtcttcaaggatcaaaagaatcaatattataaaattgtcttcaatacctaaaactccagattccatgcaatattgtcaatattctaaacacatctttcacagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctgggactatatccatgttaagcagtctttttcacataattaactgaaacaatgggtaccctttgtaagattttttaaaattaggcaaaataaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcacaaactgttgccatgatgttttctcctgactggcctgcttttgctttcatcggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcgtctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgtatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagctgactctgagtgcgaatcttcttttcaaaaatgatttaaatacttcttatctctggttcaccctattaccgaatccatagagttgtatattaattttcacttgttttcttcattcttagattttgcttttttcattcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatgggtaaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcaagatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccgctgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaatcatcaagtgttatcaaacatgtggagaaaaggacacacttgcacattgttgatggaaatgtatattagtatagccattatggaagatactatagagtttgtcaaaaatgaaaagcagaacatataatcaatccagtaatcctactactgaatatatgtacaaagaaaaaggaatcagtatgtcaaagagttatctgcattcccatgttcattacagcattatttataatagccaaaatgtggaatcaacttaagtatccattacagatgaatagataaagaaaatgtggtctatatacacaacgtaatactattcagctttgaaaaaaggaaatcctgcattttcaagaacatagaataaacagggaggacattaagttaggtggaataagacagacaaaaccacatgattgcacttatacgtgcaatccgttgtaaaatatggtgactttagttaacaataatatgttgtattcttgaaaactacttagtgtagattttaagcagtctcaccacacacaaaaatgagaagtatgtgaagtaaagcatatatttattagcttaatttagccattatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaaaaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataatagtgataatattatatatttcaatattgctgagtacatatattctatttaatatatttaagcctagcctttctaactactacagaaagagaagctaaatgtctgttgtaagtatgcttatcttacaaaaaataagttcatttgatattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaatatttatttctcctttttatagaatttcaaaatcaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcatgtgcacatcataggtgtacagtaggtgtatgtattgatggagtacttagaatgttttgatacaggcatacaatgtgaaataagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctatttttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaattccacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagatatcgcttccatacactgatttccatacactgctgatgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaactgttaattgcagagactcttttccacagcgttcctttgtcaaaaatgcattcactgtagatgtgtaaatttgtttctgtgttttctattctgttccattagactgtatgtctgtttttatgccagtactatcctgttttagttactacaactctgtagtataatttgaagtcaggtaatgttattccttcagttttgtttttattgcttaggatagctttagctatttttggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatctttttttttttggtgtcctcttctacttctatttttagtgttttactctttttcttatagagatctttgacttctttggttaatatctaattatttatttttatctgtggttactgtaaatgggattacctttaggatttttttcagattgtttgctgtcaacatatacaagtgctactggttttttatgttgatattatatcttgcacccttactggacttatcagttctaatagttttctggtgattaccttacgtttatcgaaaaaaacttataccatctgcaaacaaagataatttggcttctttcgtttcaatttggatacctttatatccctctcttgtctaactgctgtagccaggacttccagtattatgttgaataacagtggtgaagtgggtatccttgtcatgttccagtactttgaggaaattatttcagactttctccattcagtatgatagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtgtatgttgagccatctttgcatctcaaggataaatcccatttggtcatgttgaatgatctttctagtatgctgttaaatttgttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaacgttagggagaattcaacagtgaagccaatatgtcctgagcttttctttactatgaaactttttattctggctttgatctcattacttgaattaataattgatctgttcaggttttggatttctttctgcttcaatcttagtaggttttatgtgtctaggaatttgtccatttcttctagattttccaatttattggaatatcattccacatagtggctaataatgattctttgaatttctccaggatcagatgtaatgtttccttttcatttctgattttatttatttgaattctcactctttttctcttagtctggataaaggttgatcagcatgtttagtattttaaaataagaacttatgtttcattgatctttgtattttattcatttcaatttcaagtttatctgctgtgatatttattatttattttcttctaataattttggatttggattgcccttccttttctagttcattaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccacagtgcattcaggggcatattctttaatttccagattctttaattttttgtttcaacttaccatatggattgcaaatactatcttaaaaccagaaaacataacactgtttgcataaacaaacaagccaaagtaaactcataaatactttccaccttaattttcccttctgctttcaaactttttgttgtttctatttttatcttattttacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattatttattgttcatgaatttcgttttttgattgaaatattccctttagcatttcttgtaggacaggtctggcataataaaattcctcaccttttccttatctgagaatgtctttatttcttctttatgtttaagggatattttcaccagatattctactctaggataaacgtcatttttctgtcagcatgtgtcatatcactcctgtaaggattcctctaaaaagcctgctaccagatgtattggtgctccgttgtatgttatttatttctttgttcttactgattttagaatagtctctttatccttgaccttagagaatttgattattaaatgagttgaggtagtcttctttgggttaaatctgcttggcattctataaccttcttgtacttgatatagatctcattctctaggtttgggaagttctttgtgattatccatttgaataaactttctactcctatctcgttctctacttcttccttaaggtgaatactctcagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacatgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccagcaatgcagtggttcttgcagacttctaggggtactgtattgatggtcttgcacatgatctgagagaattcagggtgatgagggcccctggaccagggtggtttccaggggaccagtttcaaaaaccttagatgtctgcttgatgttatatggtactgtatctgggctggcagtcatattgcaagttaaaatgttgtggggtggggtggggggatgggggagggatagcatttggagatatacctaatgttaaatgacgagttactgggttcagcacaccaacatggcacatgtatacataggtaactaacctgcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccacggtatgtccaaaaatgccacccaccagtcaagtccaggaactggggaccctgggagcccaggtggttctctacccactgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcacgctcttggctgcctcagctggtgcagttggtgtctctgaatattctgtgtcttcccccagtccatagtctctgagcctagttcagcactaggactcacatacgtgtgcagtccttatgtcctagactgtctttctagtttatttagagacacaatgcatggtaggtagccctaggtggcaagatttgtgggaacttgatttcagacccctgcggtcagcaataccatcatggctagcattggtttaagtactccctccatgggaaggggttagctgagtttggtttggttttcctttctgctctaacagcacagcattttgttcaatgcctcacaattgctatgttctccctccctcagtgcctagagcaaggctctgtacaccatggcacagctgcaagtgtggggagaggggaaagggtagtgtcagtgattcaagattgtctgacctatctcttacgtgccactttcagggatatgaagttaaaaccatgtactatgagtgctaatctgataatgttttcattttatgaaggtgttttttttttttttttctgtgtacatagttgttaacttagtatctttgaaggggaatggttggtgtctcctattccaccatctggctctgctctgcctaatttgtggaaactctttatcatgaagaaatgtcaaagtttctcaaatgtttttagtacttctatgaaaatgatcatatagttttgttcattctgttattgtgatatgttacatctattggtttgtgtatgtctacccatctttattttatgcatagtttgaaaaacagtactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaagacaaggcattatctggtagcagctgctggtagcagctgagatcaccaacagtagctttccttgcttctggaagttttcctaaaaaacatccactgcagtacaatggataattagtggggcatcactaagattcctgaacttcggaattttctggaaatagcatttttgacctttgttccctcagttcttccaatagttgtggaagcctttcgttccctttattgatactctctttactcaaaaaatgagaaataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaacaatgaaagatttcaaactccaaacagtacaactgaaacttttgcattactatactactgagaatatctaacatgttgttactaattaatgtcattctcaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcattatgctagtagaaatagcatattttgtaagactataacagaaattaattttatgaaatattatctcattttaacttaaacaatgaataatattctctttgtttcataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatataccaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataaataattattttttatagctttatgttattgttcactgatttgttttctcctcaacagtcatatattttctatattaactatctttttgaatgcaggccttgcatattaaagaactatatcgtaacattagcagtggaaccacatgagtcaaaaatcatggacaatcaagggtttgtggccattaatgaagaatataaattttgtaattatccgaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacgatttgctagttttatttgttgtgcaaaatcaaacttgatctgtgccaaaatggaaagaaaaggaaattctcctgttatttcctttgttaactgaactgatacaggtacatttttttcaaataaagattaaatagattaaaatagaatgaaaagaagaaaagtagtaccattttgaaatgactggaattagagaagcatatgcactatactttcttacttactttcttaaaagcactataaaaaaagaatgatgacaaattcttccttatctgatattccagttgaaaacttttctcctccaatgaactttttgtaagagtaaacttgagcaaaatgtcttgtaaatttaggtcgcacctatatttctcaaaggagaaagtaactcattgggttaccttcaacgtcttggttagagagaaacatctttgtgtattcagtagcattggctcaactgcatcccgccaaaattcatttgttaaagtccaaattcccaatacctgagaatgtgactgcatttggagaaggagtgcttaaagatgtaattaagttaaaggtcaatggttcaggtgggtcctactccaatataactggtgtctatataagaagagaaaataagaacacaccatatagagaaagatcacgcaaggcatagaaaggatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataactttttactttttactcaagagtatatatatatatatgtagccaccacacagattttagaggctattcatcagaatttggtaattatatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacattaaaatcggcacaccaattcttttggaaaccacactatttgaaagacaaactcgacagaaaatttgtaattgtaacctattataatgttcattgaatttgtattggccattatttcttccattaagtcataagttatttatacttatttaaagataggttgtcaagagcattatttttaattatgaatatcctttcagaattgtataaactttatattcatctactagagttgccataacaaagtgtcaagggtgacaattagtaatgtagagcagggttgcttctaaatcccttttaaactgatcattttcagtacccaatgcattacagttaattgccattgtacttctttgggatgctcaaatttgtttcaaatctcactaagaagctggcttttgtgtatatttcatgtgcccccattaagctttggcataacaaaaggtcccatgctttccttgacttttgctactacagactaactttcaataatttctgtatgaaattccagtgccttttagtgggaaaaacgatttttagaaacaaacctaaactatgaaaaactcacttcaggtttgaaattatcgttgactaagaaaaataatatttggccgagtggggtggctcacaccttcatcccagcactttggagggccaaggcgcgcagatcacttgagaccgggagttggagaccaacctggccaacatgatgaaatgctttctctactaaaaattcaaaaaattagcaggatgtagtggcacacacctgtaattccagcttctcaggagactgaggcaggagtatcatttgaacccaggaagcagaggttgaagtgagctgagatcgcgccactgcactctagccttggcaacagagcaagactgttaaaaataaaaataaagaaagatttaaatgatttcctttaattaatgtccctttcttcctcggactaaatatcctgcaatcataagaaaatgtaaaagtatctcaggaggttacacagggcacggaagtttcgattttccaatacggaggagacagcagaaaactgtgcagccatgcttgaggggctgggtcagacaagctgtcatgcgtcacctaacaagcctctagggccagttctgtaactagcaaacgcttccctcaaagtaaagatgtcacgtctatgaacttagtcttctcatctgcacactaaagctgttgtgccactagcttccttcccgttctctctgatttatgatgattcaaacttaaagatttttctttagttatattcttaagttctcataacaaatagaatgtaaatactattttctatcacttgttccataattatagaagaaacataaattatatgctatttaaattgtggtgttgttcaacattctataggtatacatacctatagaatataagaatatatatatatttgtacattcgtctatgcacctattttttatgtcaataatatgtctcatctgatacatgaattctaactatggtaagaatgcatgccatcgcatacaaacaaaatgccacaaaactaaacaaaatgttttatatctggagataatttgctacatttcagatttttttatgctacagtcatatttcttgtctctcttttccaaaacacaatcattgctgatgtgtgcaccctaaactgacagcttgagcttaacttggtatagttgtagataagttcagtttaaattaatgctgataaaacctccagaattgctgaagagaccatactatgttagtagaagtagagaaagtgaaatgagcttcttgtcctgttagctgacttgagttccattaaagattttaagtggagaaataaaatgaccagatgaaaggtcattaatttatacacaggaaaatagattataaagatgagaggtcaggatcaggaaactagttacggttgctgtaatctcagaagaatttggttgagagacgatgatatcaaaggttattgccagggtttttttatgcctgttgtgtttatttgtttgtttgttttgacagaaaaaaattgagtgaaagggaataccacaattgcagaagttcagttattattgagagaggtaatgagaatgattgacatgaatttcccccaaaaaatgttctgtcaataattactatattacgaataaatagagcatggaatatttttacagctgactcagagaaaatagctattacagcaaacctatgtctatattgaaattcatatatacattcaaagaatattactctataccatttatctcaagagaactaatcttcaaagcaaaagaaatcagcaacatgtttttaattaaaattttaacttccttcaaaaatgtcttttgggccaggcgcggtggctcacgcctgtaatcccgacactttgggaggctgaggagggcggatcacgaggtcaggagattgagacgatcctggctaacacggtgaaaccccgtctctactaaaaaatatacaaaaaaaattagctgggcatggtggcgggtgcctgtagtcccagctactcgggaggctaaggctggagcattgcgtgaatccaggaggcagagcttgcagtgagcggagatcgagccactgcactccagcctgggcaactgagcaagactctgtctcaaaaaaaaaaaaaaaaaaaagtcttttttatttatctgttaagaacagataaatcattcatgcggcattcaagtcaaaaaagaattttttgttgttggcagatttacctagtggaaacaacatttgtatttagcttctaaagtaaattaagtggaggaaaatgaagattttcattaataaccttaatattaatagacaatggtggtactgaggagaacatctatctcttttaggcttcatgaggaaatgatgtttttcagtgtcgacaaattaatttcagctgtgtggtttgcccaccaaatatcatgcctgtaataatatactgtacttagcctaccatattttaaaatgattggtttccaactatcaaggcatagaagagaatatatagatagttgaagagttaaagaaattatagcataagaagcatgcaaaaagatacagttatagcattataatgactgtcttgagatatttgaaaacatttatgaaggggagcaagttaacttttgatgaggactgtcacagtcagtgaagcaggtaacagtattatccaacatcgaatcagaggtcaagtgattttctaaaagtgtgacctatacggatattgccatatgtcgggggtgggggtagaagagttgatctcttctgagccctccacgttttaagttgtatgattcaaaattatacatacaaaccttgtttttattacactctattttaaaaactgcagttatcttttgagttgattttataatttatttttgttttaattgctaatgagctcagaagcagttccttggaaaatatatttcactacacaattcagatatcttcacttgtaagcactgttaagaaaaatatgttagacagaagttaatgaggttaaagagtcaccactttctttctccaggctgcgtagatgacatctatgaaatgcgtttgccttgcagttccctgtcaaatttcttctatgtggagccgcctccctcagctcaaaacacacatttcagctctcctgctctctcctacaggaacactgctgttctgtgtaaagaggaggtagggccttgtctttcacgcaagcctggctcaattgggcacctcaccactggggttgcagccaccgctaatccccctagaatgtctgtcctctggtgtgtctgcaccagtctcctttgcgagtgaccacagctatgtccacagaattgggtgcaggggagatgtccccctctctacatctgtgcccaagcactggggccacctgtctcctaggatggatctatactcccttgcaaggcaagcacggtgcctgtgtgcctgctgaaagtggtctagtcactttcagcccacaagcaggtttctcttgcacacaggaaagtggaatgaacaaaattaggaatcaacaaaaaaagtttatcataatcttaactatttggatattaagaaatattcctagtctatttctgcggtttaataaacactggaaatcttggctcagtgacttgtttgaggcgtgaattagctgtgttatttttctgtgcggtattatcaaagaaaaatttttgtgttcctcaatatgtttatattgtccagtaattagaaaagagcctagtgaatttatttgttttctatttttatttttattttttgagatggagcctcactctgtcacccagactggagtggaatggcgcaatctcaattcactgcaaactctgcctcctgggttcaagcgattctcctgcctctgcctcctaagtagctggaattacaagggcgcaccaccaggcccagctaattttttttgtatttttagtagaaacgggtttcatcatgttggccaggctggtctcgaagtcctgacctcaagtgatctgcctgcctcaacctcccaaagagctgggattataggcatgagccaccgtgcgcagcccatgaatttaatccaaaacaataaaaaccttaaatccctcaaaatactacctccttacattgaatttttctgagaagaaaatacagggctctgtttactgatgacagtagaaaagaaaaaaaaaaggaatacctgagctaagtgataaaattgacatatttctcaaccaaaaagctcatttaattagccagaggtagggtatatgtactcaaggggaatacattaaataggtttgtacatttttccttctagagagccttcctacaaatttatgcatcacgtgatccacaagacataatctcatcttcattagcaaagaccttctcgtcacatatcttagtcatctgagttctatcatttgttttgacctagaaaccctaatggaatgtgtaattattctaagaagagaatataattcagtgataaaaaaatttatctctaatatgattatttattacagtaaaaagtattcatacttttttttgttttttattgcaagtgaaatcttgtgattttccagacattaaacatggaggtctatattatgaaagtatgtgtagaccatactttccagtagctgtaggaaaatcttactcctattactgtgatgaatcttttgagactccttcaggaagttactaggattacatttattgcacacaagatgggtggtcgccagcagtaccatgtctcagtaagtaaacctctggacagccatatatgtataaaactttcaaagattgaagagaggagagcacataagtgattacacttgacttatataacagaaatagggccaagaaaagagttgttcaagcaaaatgaccaaaatagatcttttctattatgagttcttaaaaatcacgagaaataaatatagagactttatgagaatatctatataattgatacatattttaattataaaaacttaagtagtattaaatattgatatttctttttgtacaaacctttgttagtaattttagttcatattcagttatacattgtttttggatgtttatgcaatcttatttaaatattttaaaaataattgtaatatactattttgagcacatttttgtgtctcatttactttattcatttatcattgttatcgtccttaggaaaacgttattttccttatttggaaaatggacataatgaaaattacggaagaaagtttgtacagggtaactctgtagaagttgccttccttcctggctgtggtcttccaaatgagcagaccacagttacatgtatggagaatggctggtctcctccttgcagatgcatccgtgtcactaagtacactactctgagatcccagcaagttcatgtctttctaagtaacacagatgacatgctaagactcatctatattaactgcggcaaaatatttatgtcaacttgcttcgccatcggacctatttagttttattttttcaattctgtataaacaaatatacacatttcttgataagttcatagtaaaataaatgctcctattattgggcattagtcaagaatacagtaaaagagtttgaaaacaatacttgttggttaaattaagacatattgaaatggcatcattgtctggagtaaatacccgaggtttctcatctggcactgagaagattaaggacatggacacacacaaggagtgggcgtaggatcgcaggtttaataggcaaaagaaagagaaaggagaacagctctgtctcttgtgagagagaggggcacccaaaagtgaattctggccccggctggggtgcactggattttataaacaggcttgaggaagcagtgtctgatttacatagggcccaaagattgattggaccaggtgtgatatttacataatgtgctaggaagctggctgccccaccctaatcttattatgcaaatgggatctttgcctggccagcgccatgttgccttttccttactgtacacgtggctggcaaagagaagggaagatggagttgccatatgaacatgcctagtcccaggtagccttttcctattggcacaactgctgccattcaccttgcaagcttccaacttgcttgtctatgtttacatctctgttttacaggttccactttgttagaaaaagaaatgatttgggggctcctattattaaaaggaaaactttaccaaggactcctgtaccctcattatctgcctaaataatttcttcttaactcgtgtatcaatattaatatgtactttggaatcaatcatttgactcaaaatgattatacatttatagtttaaaatagaaagtgagtacaatgatagccaataatgtcattcatacattcaaacagtcataggtcacttttacaataaagttatctaactttctctattatatgtaagtacaaatggattttctgggatattgtgcatattcgactctagaaggtttcctatattatttatcccaatatacatttatatcaacagttccttcttaggtgttttacatgttaatgattggtgatgtcacattttaatatttacaaattgagtggctataaaatgttttaccattgtagtgtaaatttgcatttcctttattactaattgggtttggaatatatattcacagtttaattggtatttgattgttctaatctttgaaaatgcaggttttttgacttacctttttgggagttttggtatttattagttggagtcatcttactaattctgaatataaaatctcttttaattatatgtaatccaaatgcattcttttttgtggctagtatttttcttcccttttttgtgtattatgaatataagttgctcgttttactaaataatcatcaatcttttcttatgatgaatattttttgtttctatttaaaggaatacttcaaaaacacagagccattatactatttttattgtaaaaatttacatgctaccttttttcatattttaaaattgtgtgttgattttattcatgataatagctatattttatttttaaataaaatatggcaaactcaacatttccctaacaatttttatagtacctttctcatacagtatatgctatattgtatattttgtcccctcccctcccctcccatcttctttttctctttcacagtgtgtcccctcccctccccttccctcttctttttctttctttctttctttctttctttctttctttctttctttctttctttctttctctttctttctttctttctttctttccttccttccttcctttctttccttccttctttccttccttctctctttctttccttctttttctttctttctttctcttcctctctctttttttttctttcttcctttttgttctcttttttctcttcctttctttcctttctttctctttcttttgttttttctctttctttctttctgctgttaagagtgaactacttttttcccctttcctttcctttccgttcttttctttctttctctttcttctttctttctttctttttttcctttctttccttctttctttctttctttctccttccttcctttcttttttctttcttctggctaataatatgctttgattgaatatgcaatttctcctggtatcaaacaactcaatcaaggtttatgcctcttgttttggatttggagttgtttgaagaatcaactacttattttctttctttctttttctttctttctttctttcttttcctttctttcctttcttttctttctttctgtctttctttctgtctttccttccttccttcattcctttctttcttttttttcttttctttccattttcttcctttcttccttcctttcctttctttatttctttcactatcccaagtgtgcctggctcaagttattcttgagaatgttactgttttactcttcatgctagaccctgtactttagtcaagttatttagctactttatggtggtcatataattaacaagtcttagcttcatcttcagattgcgatatcaacattgtattttcaatgtacagtcaattgtcagtgaatcacagtacttttcaatttaacaaaatctaaattcctcataaccatgttgtgaaaataagcagaaaaatttaaatatacttgtgcgagtacagtagacagatattggagtgtgtcctgcatgagtgcaaactggctgtggtttcctttaaaatagtcacttaaagaaaacatttgccaaatacatcacagaatatcaatttttctggacttgtaaaacttgaaatactggtgccttctgaatgattcttctgaagttagagtagtctgtccttatctgtgggagacaaaagctgcattagtccctcttatccacgtggggtatgttccaagccccccagcagatgcctgaaatagttaatactataaaacccaagtaagctacatttttccatctgataactgtgaagactactaagtgactaacaggcgggaagtataaaatgtgtctacactagacaaagggaggattcatgccctgggcaggatagagttgaatggcaaaggatttcatcacactacctagaatatttttttttattgctaagtattattccattgtatcataggtcacagactgttaatccattcacttgttgaaaggcatttgcatagtttttggcatttgtgaatcatgctggtaagaaaaatattcacctacagtttttatataaacacaaatttattcctcatggcttcatatctaggagtggctttgttggataaatggcatgtctctgtgtgtgctttttttattactatactttaagttctggtttatatgtgcagaatctgcagatttgttacataggtatatatacatgtgccatagtggtttgctgcacccatcaacccataatctaggttgtaagctccacatgcattagctatttgtcctaatgttatctctccccttgcctcccatgtcccaacaggccccagtgtgtgatgttcctctccctgtgtccatgtgttctcattgttcaactcccccttatgagtgagaacatgcagcatttggctttctgttcctgtgttagtgtgctgaagatgatggtttccagcttcatccatgccctgcaagggacgtgaactcattcttttttatggctgcatggtattctatggtgtatatttgccacattttctttatccagtctatcattgatgggcatttaggttggttccaagtctttgctgttgtaaatagtgctgcaataaacatgcgtgcatgtatctttatagtagaatgatttataacactttgtgtatatattcagtaatgggattggtgggtcaaatggtatttctggttctggatgcttgaggaattgccactctgtcttccacaatggttgaactaatttgcactcccacagacagtgtaaaagtattcctatctctccacaccctcgacagcatgtgttgtttacagacgtttttacaatcaccattctaactagtgtgagatggtatctcattgtggttttgatttgcatttctctaatgaccagtgatgatgagctctttttcatgtatttgttggctgcataaatgtcttcttttgagaactatctgttcatatccttgactactttttgatggggttgtttttttcttataaatctgtttaaggtccttgtagattctggatattagccctttgtcagatggatagattgcaaaaattttctcccatcctgtagattgcctgttcactctgatgatggttttttgtttttttctttttgtgctgtgcagaagttctttagtttaattagatcctatttgtcaattttggcttgtgcagcaattgcttttggtgttttagtcatgaagtctttgcctgtgcctatgtcctgaatggtactgcctaggttttcttctaggggttttatggttttaggtcttaaaaccaccttgtgttaatttttgtattaggtgtaaggaaggggcccagtttcaattttctgcatatggctagccaattttcctaacaccatttatccaacagggaatcctttcaacatggcttgtttttgtcaggtttgtcaaagttcagatcgttgtagatgtgtggtgttatttctgaggcctctgttctgttccattggtctatatatttgttttggtaccagtaccatgttgttttagttactgtagccttgtagtatagtttgaagccaggtagcatgatgttttcagctttgtgctttttgcttaggattgtcttggctatatgggatcttttttggttccatatgaaatttaaagtagttccttctagttctgtgaagaaagttaatgataccttgatgggaatagctttgaatctataaattactttgggcagtatagccattttcacgatattgatttttgctatccatgaggatggaatgttttctcatttgtttgtgtcctctctaatttccttgatcagtggtttgtagtcccccttgaagaggtccttcacatcctgtgtaagttgtattccttggtattttattttctttgtaacaattgtgaatggaaattcactcatgatttgactctctgtttgtctattattggtgtataggaatgctcgtgatttttgcacgttgattttgtatcctgagactttgctgaagttgcttaagaacttaaggaatttttgggctgagacgatcgggttttctaaatgtagaatcatgtcatctgcaaacagagacaatttgacttcctttcttcctatttgaatacgttttatttctttcttttgcctgattgcccaggccagaatttccaatactatatcaatactagacagatcggcaagacagaaaattatcaaggatattcaggacttgaactcagctttggaccaggtggacctaatagacatctagagaactctccaccccaaatcaacagaatatacattcttctcagcactacatagcacttattctaaaatcaacctcctaattggaagtaaaaaactcctcagcaaatgcaaaagaaaggaaatcataacaaaccttctctcagaccacagtgcaataaaattagaacacaggattaagaaacttactcaaaaccacacaactacatggaaactgaacaacctgctcctgaataactactgggtaaataacaaaattaaggcagaagtaaataagttccttgaaaccagtgagaaggaagacacaacatacctgaatctctgggacacagcaaaagcagtgtttagagagcaatttacagcactaaatgccacatcagaaagttggaacgttcgaaaatcgacccctaacatcacaattaaaagaactagagaagcaagagcaaacaaattcaaaagctagcagaagataagaagtaactaagaacagtgcagacctgaaggagatagagacacaaaaaacccttcaaaaatcaatgcatccaggagctggttttttgaagattaacacaatagatagaccactagccataccaaaaaagaaaaaaagagagaagaatcaaatagacacaataaaaaatgataaagaggatatcaccactgattccacagaaatacaaactaccatcagagaatattataaacacctctacacaaataaactagaaaatctggaagaaatggataagttcctggacacatacaccctcccaagactaaaccaggaggaagtcgaatccttgaatagcccaacaacaagttctaaatctgaagcagtaattaatagcctaccaaccgaaaatagcccaggtccagatggattcacagacaaattctatcggaggtacaaagaggagctggtaccattccttctgaaactaatccaaacaatagaaaaagaaggattcctccttattttatgaggccaccatcatcctgataccaaaacctgacagagacacaacagaaaaagaaacttttaggccaatatccctgatgaacatcgatgcgaaaatcctcaataaaatactggcaaactgaatccagcagcacatcaaaaagcttgtccaccacgatcatccttgggatgcaaactggctttatccctgggatgcaaactggttcaacatgcaaatcaataaatgtaatccaccgcataaatcaaacccatgacaaaaccacatgattatctcaatagatacagaaaaggctttcgataaaattcaacaccacttcatgctaaaaacactcaataaactaggtatggatgaaacatatctcaaaatagtaagagctatttatgacaaacccatagccaatatcatactgaatgtgtgtgtttatttttataagaaatagacaaactgttttcctgagtgatcatatattctaccttcacatactcagtgtatgcgagttccaattgttctacaacctcaccagcctttgagatagtggttgtttttccattaagttatccattctaatatgcgtgtaatggtatcacattccctagtgactaatgctgctgagcattttctttgtacttatttaccatctatgtacctcctttagtgaggtacctcctttagtccaaattttttgcccatttttcattgggttgtttgattctttactgaattttgagacaacttaatatattgtggctacaagtccttcactgagtaaatattttagaaatatttttcttgcatctctagctttacttttatttctcttagcagtctctttcaatgagcaaatgcatttaattttgatgttatccagtatatcaaatatttcatttatggattatgctctttgtaccatctaaaatttccttggcctaaaccaaggccatgtacagttctagaagttaacattttacacatagttatatgatcgttttgagttaatttttgtatgaggtatgagaaatatgttgagggtttttattttgcatttggatgccttactattccagtatcccttgtttaaaggattgtgttttctttattgaattgcctttgctccactattaaattggaaacatcttcaagaaaatcttgtaaaaacagttaaagaggaaaaagtgaaattcaattaggcttgttggacaatccatggtagtcattaggctagctttcccactggcccatttccttatagcttgtcactgattactagtacaggataacataatctttgtcactagaatctttgttccttttctgttctttagataaaatgtaagacactacgcgatgacaatcttgccatttgagtttctcctttaggttctgcatactaacaaaactactgatgccagccattctgaaagtcttggcaagaaactcacttagggaggactgtagtttccatatcctgatgatttcagtccctgacctgaatcaattgatgacctcaatttccagcccctcacccttcaaagactcttgcccagaaacccttaatgaaatgggtttgagttttgagaattcttcccaagtccttgcttggtgaccttgcaattagtaagttctttctctgttgcaaaccccacagtctcggtgtattgttctgtagctgtgcagccggcatagaaacctgacagtcttgtaaaaattcatggcaagtggccaggtatggtggctcacacctataatcccagcactgtggaaggccaaggcgggcagatcacttgaggtcaggaattcaagaccagcctggctaacatggtgaaaccctgtctctactagaaatacaaaaatgtatctaggcatgatggcatatgcctgtaatcccagcttctcaggaggctgaggctggagaattacttgaacctgggaggcggaggttgcagtgagttgagatcgtgccactgcactccagccagggagacagagtgagactccggctcaaaaaataaataaataaataaaaatcatggcaagtcactctccttgtggttatttatctacagtccagtgccccccatgccactggggctgacccacagacaagcccaggcagctgcttagctatgatgaactaagggcctttgctggggccttctgtgttggcagggcagtgctgactttcagcacataaacttgtctgcagcagagaaaccatttgtggtctcagaagaagtctcaggtgagttttctcagagcagctggcaccccatttccttctgttttttttttgttgttgttgttgtttgtttttgttttttcatcttagaggccttgtgacctattttgaggtcttgttgatcctccctaagtcataggtagggccttatttgaggagacctcccctcagatggaaggagactagagggcattgcttgggagaaatgctcttggattttggaatctgaaactttatatttaaaggtcttttgtttgtgtttgtcttgttataggtatttatgtttgtggaggtgttctctgaagaaattactagtggaagaaattactaactcaggaaactcttcttgtttgtctggtcatttatattcacttagtcctgaaggagttgctagtggaatctcagcaagtctaactcagggtaaccgtctgctcttcaatccttcccagagtccacccactgaactcctgactgaaggtcatccctctccaacttgagtagatcaaatatgatgagggctaatggaaccaagtttgagccttgccaggtcaatacttgggttctgagtacggtgactagtatctgtgtttggttacatgtatataattccagccagaatgtgaaatgttaattcagttcctccctgcagcccagtgagggctggtggctttgagattattactctttctctgctgcaaatcccactgtctcagtgtattgttctgttgctgtgctgcaggcatacaaatctgacagtcttgtaactatttgtggcaagccaggtcgaggttactctccttgagggcatttactcacagcctagtgcccccttgccactggagcagacccagagacaagcactagcagctgcttagtagttctgatgaactaatggctgtcctttagttctccccatgtaacccacactgtaattttgatgggctgcatcttccaaaattgaaaagcctttgtctatcattccataaagcaaaacaagattatcttattttttaacatggcttgacctcaatacccatggggtttgggagaacagtggccactgcatggttctcatacttacagtaccatcctgtagctagatttgttatgtatgaaggaagagaaatgggataaaatcccttatgtataatgttttatgttgctttggtaaagtagatcaatgtagaaaaaacggaaaaattatgaattagcaagaaattaaaacctgtttggattgatttacaagagaaagaacttatggaggagctgcagtagcactactggcacctaagccagagtccccaccaccaaaaagtcacaaacccagagcaacaggaatttttttttttttttatggagtcttgctctgtcgcccaggctggagtgcagtggcacgatcttgctcactacaacctcaactgcctgtgttcaagagattctcctacctcagcttcctgagcagctgggactacagacacgtgccaccaagcccagctcatttttgtatttttagtagagatggggtttcaccatactggcgagcctggtctcgaactcctgacctcaggtgaaccacccccccccttggcctcccaaagtgctgggattacaagcgtgagccaccgtgcccggcctttatctctgcttcttctacccaacaggtgactccttttagctagggtatcacttatacctaacaggggactcaatttagccaggatttcactctggctctgaaaggcagtttcccctataacaactacctataggaggtgatgctgccacagcccagcctataggatttatgtgggtttattctctgttctccactacccacctatttaattagaaaaataatatgcctatttattgagaagatctaaagtttatggaagaaaaaggataaaaaaaaaatccaaagcatatggagaatctattctcctctgtatttgccacccacaatcctacctgagcagatacctaaaatttgctcaatattttgttgagttcagagaagcaaagaatggttttagaaaaagctaaggaaaaggctgatcttattcacactgactctcccagtaatccagtaagggcagctgctcagattgcagttcccacctctgtcctgggatggaatataaacactggagatagatctaacctcgaacactatcaaaactgcattttggccagcctctgcaagggagtgcccaaggaaagcggcctcagtaaggtccaggagatcaagcagaagcctaatgagtgtgcctttggaatttttagaacaagtctttgaagctttcagacaataaatggatattgactcagaagcctcagaaaatttaaagttagctaatacgatgtttatccaacaaagtgccccagctatgcagggaaagttacaaaatgtagatgaggctttggacatgtttatgtctcaattagtgaagattgtttttaatgtatttactgatcacaattttaaaaagtgaaaaataaaaacacaaggaataatgaagagaaaagctgacttgttagctgtggctctgaccctagtagtccctggaccacaacaagggccctcatcagatgctccatctaaggtaggaccacctgggcccccaaaagccaaaaaaaagggacatcccattgcaggtcccaagcagtgtgcttactgcaacaggggggacactgaaaggaaaattgcccatgccttacaaagcctgatgttaaacacagtcagtcttctgcccaccaaatgcctgggatagctggggagcttgagagagatactgaagaaaaagaccagaaatgatggcacccaggggcttatcctgactcaaacaacaccctccatatttcccacatggggcttgagatcctgatgatggtgagaaatcagcttctggacttcctagtagacatggtgccacctatttggtgttaaatatctggttgtctaaactttcctcagaaactatgaaggtgactgaaatctcaggaaaaatactgatgagatcattcctcccaattttggattctcagctagagtaaggtaatttaaagcagtttttctatacatgtgtgaatgtcccatccctttgttggggcaagtcctcttaaccaaactaaatgttaagattactttttctctgagatgattggacatccaggtgccttcagaccaagcatgtgctctgcaggccacattattacaactggaagtccttgaaagtgccctcatccctgaagagatactccaaaatgttagtccgggagcatgggaaatggaaggccagggaaaacaaaaactgcatctccagtacaagtcaagttttgtgcaggagtagcgctgccaaatctaaaacagtatcctttgagagaaaaggcacagcaatgcatttagcctctgctaatggccttcctgcaatacaggaagacttcatcattccccatgtaatgtcctaaagacacagtcctgggtcaattgaagggtggcatgcctgccatactgtgtggtatcatgtacgtgtttgatgatatctgtcgtgagatacttgggtaccagaaccttttcttctgtgttacatatctactcaggaatattgattcatacaggatttgagggctactagccaaattttcaaagtcatttatctggtggtacccgatgcttatacattattcatgactttaaccagtgagttgtactggtgttcagtcttggatttgaaagatgccttcatttgtattcctctgagtccagagtcccatgaagtgtttgcctttgaatatgaagacactgacactaaagcaaaccaacagtattgctggacaatgcttcctcaaggcttcaaaaactcactaattggttgggaggaaatacgtgctaaagagtttgggaccttcgattgaaaaatgggactttgtttatttatgttgatgacatatccatagcccccaaaactaaggcaaactgaccagaatactatactgactttacatttcttgtctgaattgggatccaaggtatccaagaaaaaggcacaaatcttgaaaccctcagttacatatcttggatttgaactttctcaggagcagagcaatctgctttcggactgcagagaagctcttgtcagggtggccagactcaggacatggcagcagctgtgaggggtttttaggtatggctggatgttgccttatttgattttcttattttgggcttatagcaaaatctccctataaagccctaagaccagacagttgacttctggaatggaccaaggaatgtcaaaaggcctttctaaccattaaataaaaattgttaatggctctggctactggtaccccctgaactaagaaagccatttaatttgttcatatatgagagagaaggggtgagtttaggagtactaacccaagacttggggaatatcatgaggcctgtagcctacttttcaaaacagctggacattgtccaaaactgggttggacttcttgcctctgagccattggtaccacttgtgatcttctccaggaggcagaagagttcactttgggttaacctagcacagtacacaccccacactatgtatgctctttgtcagagcagaagtggatctactgacttaattctagaagactgaatagatatcaggccatctccctgcataatcccagtgttactctgagagctgtttctactctaaatcctgctaactaaatctatacatgattgcttataaagtattgagcaagtttattctattcaaccagacttgaccaaaattccctttaaaaacctggacttagaaatattcactgaggaaagcagctttatgaaccacagacaacagaaggctgagtatgctatggtaaccctgtgacagatcctagatgcagagacactcactctgggttcatcagcacaaaaggcagaacttagagtcctaaacagggcatcccaactatgtaaagactcctgagtcaccatttactcttattccaggtatgcttttattgttgtccatgcttatggggctactggaaagaaaggggattcttaacctttggtgattaaaaaaaaatgattaagcatgctaaagaatcttagcctgactaaagacagtcttggtacccaagaaagtagctatactacaccaccctggacatcagtggatggacaatttggtagcaagaaaaaaatcactaggcagaccaggccactaaagggatgaccagagaaaaagtacccaaagccttgctaatgccattaatccctgaaataaacttcagcctaaaatctatacctatttggaagaagatctaaaagcacttgattgaggctttgactccaatcaaagaacccaaaatgagtagatatgtaacacagaagaaaaggttcttgtacccaagtatcttaccacagatatcatcaaacacatacatgataccacgcagtatgacaggcatgccacccttcaattgatccaggactacgtctttgggacacacttaaagaaggctatccaacaaataattctaaaatacctactttgtgcccagaacaatcttaagactggtcctccacccccagttccagggattcaagcaagaggtgcagggcaaatagaggactggcaaattgattttaacgtgatgccaagggtagcaggaaattttaaatacttgctgatatttgtagatacattttcaagataaatgaaagcattcccctgcaagaccaagagaatgtatgaggttataaaagacttgttagagaagattaccctcaggtttagatggcctgtcttcatccagtgtgactatagtgcaacttttgtagcctaggacaccatatattccaggccctcagcataatctggaatcctcatacagcctggagactgaagtctactgagaaaactgaaaagttaaatcatactataaaaaacaaaacaaacttttgctaagatttgccaagaaactaacaacctggaataaaattctgtccttctccctgctcagagtaagggtggtccctaaaagtgggcttaaataagccctttataaattttatatgggagattattctgttctcttctcagactaaggaatgccaataatatacacataaagaaattagatattatcaaatatatacaatctttaggtcacactttaattactatttatgagtttgtggttccagcagattgtggtatccaactgacattctcttgcgtcgcatccaaccaagagactggattctgctcaagaccaggaaaagtcaacatcctgaggaccacttgaaaacacagtgaaagaggccatacaatgcatgactggtgactcattcctctgttcgggtgaaggacttagaccctggattcaccacagccatataaaacccaccccgccagactctagtgctatcaagaaatgtagaaaggccaaccctatctgaatggataagtacatctttgatgggcctcaaatatcttttgaagaaaaatatcatataaataacaaacttaaagaaaattagacaaaacacatgtcctcttgacaactacaatagttactttgagcataataggaatttttgttataattattttacataaaaaggtgagataccttcctgtctattccgtgccttactgaatgcttaacccatagatttacctggtcattataattgccttggtcattacaattgctacacttatagattttacttcacaattgccttggtcattacaattgctagacttacagattttccaggcatcctataccatgctgacttagtctcctgcctcccattatttggacattctaaaatttagaaatggtcactcttgttttaaaacttctaataaatttccttttactgcaatgcctagacagggataacaacactgtagttaaactgcttcaaggtattgccactggaagaaacctaccagaatgatggatctgtcagtaactccctcaaacgattcaaaataagcatgttctgttagtcatacttgtcactgactttctgtcccaaatacgactacctatctgcaacagcttctttccatggctaatttccaggtccaactggtagtacaccaagaaatcaccaccccacatctcaatctctctctatatatcataaatggaaagtcattccataacataggccctccacggcccatggcataatgggtagacaaatgcagccaggagaagggaaataaaattaaaagtttctctttgctgcaccaaaaatatttacagtggggaatatcacacaaattttggggagcctgtagaaaaggatccacagttcaattccatttgcctatattccccatgaaaaaaaccatcaatacatgcatctttgagggcttcacttgtgtgtccccttggcaaatgtttatttgtgacacaggatcagaacatcctctgttaggacaagctcactggtgtctcaataacctgtatattgagggctcttacttattgggacactggtcagtccatcctaatgactaaagattctgcccattttcccacggactccaaaagccactgccaggcatatatcaatatatccggtgacagggccttcttgggcatcacaattcctagctatgaagtatacactaactgggccatgatcagaaacttaccggcaactttagaaataattgcaaaagaggctgctaagaacattaaggctgagaaaactctttacatttacttacccagatagttcttaacaatggagctacacttgattttctcttggctttactgaggggagtctgtacagtgatcaataccacctgttatacttatatcaatgcttctggtaaaataaaaaccaagctaaagaaaatatttcagcagtctcgctggagaccatatgtctataccacagaccctaagtctgactagttttttgagcttttcccctcgatactccacgttttccagtccattttccaagggctcttaaagttcaagctcacaattctgtttatagggcttacagtttacatcataggctgctattcaattaaatattacaataaaaccatagactgaagtactaacatgttcatgcagcaccttcagctgggtgtaacgacttgcaggttgttacaatacggtttcattcctctaatcccgactcattctctgactgtgccccttatcagcaaaaagaagctagagtcgtcattgcctgtttcccaccatattagctgttacacctcaagattaagaagggatcaagcctgggaggaactgaaactgtccctaagaaaattacataaaattgattaaggggggaaaattcatctacgctttcaggacaagcagcagtaatcattaggccagctttccctttgtcctacgtctttgtagctggtcatggattactaccaccctaggataatgtagcccttgtcacaagaccttttggtccttttcttttctacagataaaatctaagacattgtgagactataatctttctgcatgagtttctcctttaggttcggcataccaaaaaacctatcaacatactcgtcaacaaggcaaaaccacattttcacaaaaaattaaagaaattaggtcaggcatcatggcacaggtctgtagtaccagctgctcaggagatctgaggtgggaggaccacttgagcctgggaggcagaagttgcagtgagctgaggtcacgctactgcagtgaggtcacgctactgaaatccagttgggcaacagagcaagaccatgtctcaaaaacaaaaaacaaatatacatacacacacacacacacacacatacacacatcagctggtctaaagagcccagcaaaaagctgactcaggaaataatgcaggttccacatcccacatcccggtgatttcatcccccttaccctgaccaattgacaacccaaattttctagcccctcaccctccatgatccccttaaagtcccttgcccagaaccccttcacagaacagatttggggcttgagaatcctcccatttccttgtttggtgcccttgcattgattaaagtttttctttgctgcaaactctactgtctcagtgtattggtctattgctagacagtgggcatgtgaacctgatagtgttataacaaaatagaatagaagctatttacaaaatcgatccatgcatgtgagtctatttctggacaccattttctcttctattcttctgtgtgtttatcctttcaccagtgtcaggagatccttttactcactgtagctttttctaagtcttaaaatttggtaatgtgagcttttcaacttctcttatcttttgaagaattgtgtagctattttagtccctttgcctttctgtatgactttagaatcagcatgtccatatgtgtaaaacattgtgcttggttattcactagaaatgggacacactcatagatgaatctggggagaactgacatgtaacagtattaaattgttcagtccaggccgaccgcggtggctcacgcctgtaatcctagcactttgggaggctgagtcgggtggatcacgaggtcaggagatcgatcgagaccattctggctaactcggtgaaaccccatctctactaaaaatacaaaaaattagccaggggtagtggcgggcgcctgtagtcccagctactcgggaggctgaggcaggagaatggcgtgaacccgagaggcggagcttgcagtgagccgagattgcgccactgcactccaccctgggcgacagagcgagactctgcctcaaaaaaaaaaaaaaaaaaattcagtccatgagcattatatatcctttgatttagtaagatcatacattcttacactagttttttttgtgtgattttcagcatacagatcctgtattttattagatttatcactaaatattttgtttttcatgcttcagctacaaattcaatttgtttaatagatattatttattaatgctacctaatccttcttcagtgagctgtgacagtttgtggctttagtaagtttctagttcattcaagttattgaatttattgacatggcattattcagaatatttctttatttttcttttaatatatgtaaaaaccataatgatgtcatttctgtcattgctgttataagcaatttgtgtcatctttttttctgattcagtctgtctaaggtttctcaattatagagatctaaaataacaagcttttggtttccttgtttatatacatatttacttattatttcatctctgatctttattgtattatttcttctgcttactttgagattaattttttctactttttctaatatctaatggtagaggctaaggttactgaagtggaacactgccattttctgtcccaggtatttagtgacaccaatttatttcatactgctctagtgtcattccacaacttttgatatgtagtttggctggagtagggagtttggctggagtagggtgagtataccataaaagatttactgtgttttttggaggcaggtggggagagggaattattgccaaaaggtgggttattttatgtatttatttttttaactccactctgtattttagctaagagaagcagctttggaacttctgaagtctgtacatctctgtggcccccaaggattacttgttttaaattttgttttaatagtctaagtttatcatgggtcaacttgattctttcaaggcttatttttaagcttttaaaaggctggtttagcggctgcctggagcggagcgctgcgagagctgcgcggcgcgcccaggttccagccggctccgctccgggtcccccagtgctcgctggctccccgcttgagccagcccgcccgcccagcgctaggggccaaggagcgaaccgcacctgcgatccgattgtccggggcacgccgtagaggatgggaggacccatgaggcgctagcctgcgaaggtggcggtgctgctgctccggctgctcttggagttgcatgtacacgacgtggcagactttccaatgggaggattgtggattctgatgacataggaaacttcatcttccagacattgccacagaaagcacacagactttggaaaccagcagacctgaagtcaaatgtcgactttcagcttgctcctgtgtcacctttgtaagttaattcacctctctgagactttagtttgctcatttataaaccacctaactcccagggttcttatgatgttaagtgagatttcatatgaaaagcacctagtggattacaggcattccatgtatggcaactactgtttttgccttctgaatgagctggaattaaaagagtctctacatcattggacatttagggaaatgccaattaaaatcacgatgagctaccagtacagcatcagatggctaatatcaaaaaacagataataagtgttagtgacgatgtagagagaccggagccctcttacattgttgatgggaatgtaaagtaatgcagctgccttggaaaacagtttgacagtctctcaacaagttaggtaaggagttaccgtgtgacctggcagttccactccaggtcttggagtggtcttggagtggcatgtacccattctgcttttcttggtatgtacccaagaaattaagacatttgtccatgcgaagatctgtatgcaaatggatgtagcagccttatacataatagccaaaatgcagtatcaacccagatgcccatgagctggagaatggataaacaaaatgtggtgtcttcatagaatattgctcaacactagaaaggaatgaatttctggtatatgcagcaacatacaatccagacataagagactataagttgtatgattttctttaattgaaccatatagcaaaggcaagactatggataaagatacaaagcagatcagtattgcttgcgggctgggataggagttggaattgactgcagaacaacatgagggaactctgtgaagtgaaggaagggttctgaagttggattggggtgttggaggcacagctgtatacatttcctaaaacacatcaaactataccttgaaaatgggtggttttagagtgtataaagtaaactgagctagaacttggatcacctgatccaagtatcataaattgtgatttatattgataattatgtttaaaagataccatggttttcagaatgcttgtgctcagtgggcatgagtaggagctcctgagtgcccgtgtgtgttgggtattgcagttaatccagtcctttgcactcattgaggactcttacgtgtcccttgtctcttgccacaacagcctctatcaccagaaatgaaggcttcagtagagagatattttaaaaagaaatcacaccatccaaatacaacactgtgaatttaggcttatgctgttacattctttctcctatgaatatgtttatttttacgttgttgaaattaaatatacataatgtgttttaaattaactatatgcaataaacattttccaggatgttaaaaaaataaaaatatattgattcttcctatccaagagcatggaatgttctttcatttgtttgtgtcctcttttattttgttgagcagtggtttgtagttctccttgaagaggtctttcacgtcccttgtaagttggattcctaggtattttattctctttgaagcaattgtgaatgggagttcactcatgatttggctctctgtctgttattggtgtataagaatgcttgtgatttttgcacattgattttgtatcctgagactttgctgaagttgtttatcaacctaaggagattttgggctgagacgatggggttttctagatatacaatcatatcatctgcaaacagggacaatttgacttcctcttttcctaattgaatacccttgatttctttctcctgcctgattgccctggccagaacttccaacactatgctgaataggagtggtgaaagagggcattcctgtcttgtgctgattttcaaagggaatgcttccagtttttgcccattcagtatgatattggctgtgggtttgtcatgaatagctcttactatttttagatacgtcctatcaatacctaatttattgagagtttttagcatgaagggttgttgaattttgtcaaaggccttttctgcatctatgagataatcatgtggtttttgtctttggttctgtttatatgatggattacgtttattgatttgcgtatgttgaaccagccttgcatcccagggatgaagcccacttgatcatggtggataagctttttgatgtgctgctggattcggtttgccagtattttattgaggatttttgcatggatgttcatcagggatattggtctaaaattctctttttttgttgtgtctctgccaggctttggtaccaggatgatgcgagcctcaaaaaatgagtgagggaggattccctctttttctattgattggaatagtttcagaaggaatggtaccagctcctccttgtacctctggtagaattcggctgtgaatctgtctggtcctggactttttttggttggtaagctattaattattgcctcaatttcagagcctgttattggcctattaagacactcaatttcttcctggtttagtcttgggagggtgtatgtgtggaggaatttatccatttcttctagattttctagtttatttgcgtagaggtgtttatagtattctctgatggtagtttctatttctgtgggattggtggtgatatcccctttatcattttttattgcatctatttgattcttctctcttttcttctttattagtcttgctagcggtctatcaattttcttgatcttttcaaaaaaccagctcctggattcattgattttttgaagggtttttttgtgtctctatctccttcagttctgctctgatcttagttatttcttgccttctcctagcttttgaatgtgtttgctattgcttctctaattcttttaattgtgatgttagggtgtcaattttagatctttcctgctttctcttgtgggcatttagtgctataaatttccctctccactgctttaaatgtctcccagagattctgctacattgtgtctttgttctcgttggtgtcgaagaacgtctttatttctgccttcatttcattatgtacccagtagtcattcaggagcaggttgttcagtttccatgtagttgagcggttttgagtgagtttcttaatcctgagttctagtttgattgcactgtggtctgagagacagtttgttgtaatttcagttcttttacatttgctgaggagtgctttacttccaactatgtggtcaattttggaataggtgcagtgtggtgctgaggagaatgtatattctgttgattttggccataatgcccaaggtaaattatagattcaatgccatccccatcaagctaccaatgactttcttcacagaattggaaaaaattactttaaagttcacatggaaccaaaaaaaatcccgcatttcctagtcaatcctaagacaaaagaacaaagctggaggcatcacgctacctgactttaaactatactgcaatgctacagtaaccaaaacagcatggtactggtaccaaaacagagatacagaccaatggaacagaacagagtcctcagaaataataccacacatctacaactatctgatctttggcaaacctgacaaaaacaagaaatgggggaaggattccctatttaataaatggtgcttggaaaactggctagccatatgtagaaagctgaaactggatcccttccttacaccttatacaaaaattaattcaagatggattaaagacttaaatgttagacctaaaaaccataaaaaccctagaagaaaacctaggcgataccattcaggacataggcatgggcaaggacttcatgtctaaaacaccaaaagcaatggcaacaaaagccaaaattggcaaatgggatctaattaaactaaagagcttctgcactgcaaaagaaactacaatcagattgaacaggcaacctacagaatgggagaaaatttttgcaatctactcatctgacaaagggctaatatccagaatctacaaagaactcaaacaaatttacaagagaaaaactaccccatcgaaaagtgggcaaaggatatgaacagacacttctcaaaagaagacatttatgcagccaacagacacatgaaaaaatgctcatcttcactagccgtaagagaaatgcaaatcaaaaccacaatgagatatcatctcacaccagttagaatggggatctttaaaaagtcaggaaataacaggtgctggagaggatgtggagaaatagaaacacttttacactgttggtgggactgtaaactagttcaacaattgtggaggacagtgtggtgattcctcagggatctagaactagaaataccatttgacccagccatcccattattgggtatatacccaaaggtgtgaagagggtattattgccaaaatgtggattttttttttttaactacactctgtattttggctaagagaagcagctttggaacttctcaagtctgtacatctgtgagaccccaaggattacttgttttaattttttttttaagtctaagtttgttatgggtcaacttagttctttcaaggcttatttttaagcttttaaaaagctggtttagggaggctagaactgtgtcccagttctagcctctgggtaaaccgcagagatagtttgttcagaatattaagctgcttctgatgtctctactaaatgacctagatgttcaaacgagtctttctactccgattgattccatttaaatgtctccctgtgttgtgtgtgctctgcgaatcctttacctttttgttctctggtagtgttcttcatctgataggtatccttggtccattcttggggagttttactctactctccagagtgtcaatattcatccaaataatctagggagttgttgtggaaatttgtagagccctttcactccatagtttcttcttttctgactctctttcctgcagattctagtgacctcatcttctttgggaacattgagttttgtttcttctactcagcaagtctgccattttctgcttgaattctccttctccgtgcggctgtttggaaattttctcccagcataaagtcactttgatgatggaattcatctcattgtcactttttatctggaattaggtgcttcctgctttccaatgtctgaaaatgttattttcatctatttggttccatttccttatttgtggctggaactctgttttacttgattattcttgcctgagcttttacctttttaaattgtctctactgtttgttttctatttgatttctacttatatttgaatttgtttcaaaatttatactcatgctgtattttgtttgctttctttgttataatttattataaataataatttattttcagttttactcttttcttttatagctatgtaatgataaatttccctctaagcactatttgagtgtcatctcaccaagttttatttaatatgtttttattatcattcaattcaaaatatttgatgtttcctcttccaattttctccttatccatgagttatttataaatgaagctgatttctgggaggcaacctaggaaccaacagtaatttctatcatcagtttacagagacagtaatgtccactctttcaagttaagtactacataatttgaggaatcatcattttggcctttcaagataaataaatctgttactgtctctcatcttctttgaactccacatgtccatttactttgaagcacacagtaagaatggcatttcaaattcttggagccaaaggctatgacaattattttggcagattttctaagatcatcacgggatctcagacactccaattggttaaatgagttttggaattgcctaaaagatctaaaataggcaagattaaaaagtcttaagaaataatactcattgtctattgagttctgacatgctgtagaattccaaatccattagaccaacagatttccaataatttcttagaaataattgtaagagtcttaaataatgccttgttttagaaaatgatggagagtcttgatgtaatgtctttggcaactcagaacttattttctttgacttaagtatctgaatgcttatgattatccaagttttcagttacaaatcactcattattttttatatttgcatattatttacattcttataaaatgttattgaacatatgcttgtctttttcttattctcttcctttttagaaacatgttccaaatcaagtatcgatattgagaatgggtttatttctgaatctcagtatatatatgacttacataaacaagcaaaatatcaatgcaaactaggatatataacagcagatggtgaaacatcaggatcaattacatgtcagaaaaatggatggtcagctcaacccacatgcgttagtaatttattatgtttgtattgattatccagatgatacacaaaagtttactaactttagtctttttatgggggctgatataatttcatttgaaaacataagaaaaaaactttgaggaacaaagcagacatcaatttttttttccttttcacattaattactcaaatattagtgtgcttttccattcaggcttttcccactctaaagcattctgtgttacagagacgagttagggagctttatgtgtattctggtttaaacttatttctttttagctgagacctttataactgttgtatatacctgttttatgtgattagccttctatatcaaagtctttctcctagatataaaagtaatgtttttaatgaagatatggaggcatagtgcataatatcaaaataatttaaactctataatttgtagatttggcactgtaggatatgtccaattctgaatatcttcccccttagaaattttttgcaaatatataggtagtagagagacaaaatatttctagatggtacccatttctgctctattgaaagatttccctaccatactatctaaatatttatgaagattttctaggaacagttggctcagtttgtgctattttttgcaaagccactcggtaatatatgtatatttatatatatatatatcatatatataaagatatatatattatatatttatatttatatatatatgatatatatgatatatatcatatatatatgatatatatatgatatatatcatatatatgatatatatatatgatatatatcatatatatatatatatatagagagagagagagagagagggagagagagagagagagagagagtcttgctctgtcatcgtccaggatggagcacagtggcatgatcttggctcactgcaacttctgccttccatgttcaagcaattctcctgcctcaacctcctgaatagctgggattacaggcacctgccatcttacacccacctaatttttgtatttttagtagagacagggttttgccatgttagccaggctggtcttgaactcctgacctccagtgatctgcctgcctctcagtaatattagtgaagtaatgtttaatatactcacattaagtgaagttaatatttaggatattcatgcatactgttttcatttcttttttaaatgtctatgcttaatatgaggtctagtttacaaaaatgttactcatcataaaaaaatcttagtaaatttttattaattattcttttaagattttcttattatgaaagagaaaatgtcttgtataacaaaggaattcatctttttaatcctttttttccctttttacatatgtctcaactacaatttagcctggacttttaatgtataaaattctgttatgattttctttaaaatgtaatatacacctgtagtgacctgttttattactagcattgtcataaatgctttagtataaatgaattaagaaaaatgctcttaaaatagattttggggcttatcgggggaaaccagcccctggcaattcaatgtaggttcttttctatttccctaagtgtcagctggtctgagaaataaagggaaagagtacaaaagagagaaattttaaagctgggtgtccaggggagacatcacatgttggcagattccgtgatgccccccaagctgcaaaaccagcaagtttttattagtgattttcaaaggggagggaatgtacgaatagggtgtgggtcacagagatcacatgcttcacaagccaataaaatatcacaaggcaaatgggggcagagcaccaggacaaaattaaaattgctaatgaattttcaggcatgcattgtcattgataacatcttatcaggaggcagggtttgagagcaaacaacccgtctgactaaaatttactgggcgggatttcctcgtcctaataagcctgggagcactacccaaaaccagggcttatttcatcccttatctgcaaccgtataagacagacattcccagagcagccatttcagagatctccccctagtaatgcattctctttctcagggctgttccttgctgagagaaagaattcagtgatatttctcctatttgcttttgtaagaagagaaatgtggctctgttcttcccagctctcaggcagccagacctaatggttatctccattgttccttattgtaccttaaaataatacataccccaaaacacaagtttaaaaagattgagatatcaagaatatgctgaaacttttgtactcagtatgatccattgtgagttatcaaaatcagtatgctactctaaacacatgaaaatacagacagtggaatggggtccagacatactggtttgttttcatacgatccttaaataattaagttgggtattgggaagcaaaggacgatagaatattaaagtaacatggaccctgagagatattcatttatgattcatctgcttgtggaagaacttcaaacaattttccagtctttaattttaaaattagtgttctcgttgtaagaagagtatgtgtgtgataggagatagtattatgaccatttgtggaaaaaaaacaacctaccatgctcaaacagcaggattttcagaagtagaatagtgtgccagatgtttattttcaacgtgatgtcaacacggctcctatcttcattttcttctccattgcagaagataagtctgaaactacagtttctgaagcctgtttctccataacttgcttcttccttagattcccccatgagatgtacttaaagaagacttggaagaagagaaagacaaggcattatctgtcagcagctgctggtagcagctgagatcaccaacagtagctttccttgcttctggaagttttcctgagaaacatccactgcagcaccatggataattagtgagggcatcactaagattcctgaacttcagaattttctggaaatagcatttctgacctttgtccctcaatgcttccaatagttgcagaagcctttcattccctgtattaaaactctctttacttaaaaaataagaaataaaaatgaattaatgttttatgttacttttggagttggtccattactgtcactaaataaagctgtacatgtacataccagggaatcaattccagagatgattgtgaaaccactaacaagaatcattgaagcattttgcaaaactctctgaactttgatatttactaagtgaccttaaagccctagctttgtggtagtgcacttaaattcagaatcacacttggtaactaataatgaaagatttcaaaccccaaacagtgcaactgaaacttttgcattactatactactgagaatatctaacatgttgttactaatcaatgtcattctgaccttgtgggtttcctgtgctaatggacaaggtaagttgaaagagatctaaacactcagcttccctcttaaatgtaacttcgtgtaatatctaacttcatatgtctataatttttttataaatctgataggatatattcactatgctagcagaagtagcatattttgtgagagtataacagaaattaattttatgaaaaaatatctcataatttaaagaaaaaatgaataatattttctttgttttacaaattctacagtgtaaaaagcatctaatattcattatggagatatatgaatatactcataaaactttaagtaggaaacatgtcattagatagattctaaccttaaaatgttcagaattttcttattcataatacaagggaaactttgggagtgattgatactttcataatcttacatacagtgattttttattgattcatatatcaaaacagcaaataaaatattttaaattatgccatttcttatatttctattataccttaagaaagctgctacatctaattaacattaatatgaatttaatatttcaacaagattagcaatatgtaaatcacaacatatatgtaatcaaaaagcagaatatatacttaacttacattggaatgacagtaaattttaatttgcatttctgagttcactagcaaatgttcaataaataaatacataaataattttcatagctttatgtcattgttctctgatatgttttctcctcgatagtcatgtattttctatattaactatctctttgaatgcaggccttgcatattaaagaactatattgtatgtaacattagcagtggaaccacatgggtcaaaaatcatggacaatcaaaggtgtgtcaccattaatgaagaaaacaaattttataattatccaaaactttataatattccaacaaatgtaatggaggataatattggaaatcccactatcaattattgagagtatcttttccctcagcctctcctctcaaagctatgccactttatttgattctaagtaaacagctttaggttttacagtattatctatcacatgattcgctagttttaattgctgtgcaaaatcaaccttgatttgtgccaaaatgaaaaaaaaggaatttctcttgttattccctttgttaactaaactgctacaggcacattttttaaaataaggattacatagattaaagtagaatgcaaagcagaaaaatagagaaaaacagtactattttgaaatgactgaaattagattagaataagctctactttcttagttactttctcaaaagcagtataagaaaagaatgctgacaaattctttcttatttgatattccagttgaaaacttttctcctccaatgaactctttgtaagagtaaacttgagaaaaatgtcttgtaaatttgggtcacacctatatttctcaaaggagaaagtaactcatttagtggaataacatcttgggtagtgagaaacatctttgtgaattcagtagcattggctcaactgcatccctccaaaatttatttgtaaaagtccaaattcccaatacctgagaatgtgactgcatttgaagaaggagagcttaaagatgtaattaagttaaaggtcaatgattcaggtgggacctactccaatataactggtgtcaataagaagagaaaataaggacacaccatatagagaaagaccacgtaaggcatagagagaatacaaccatttacaaggcaaaggaagaggcctcagaagaatgcagccctgttgacagccacatctcaaagtattagcctccagaactgtaagaaaataaatttctatgaaatctgtggtactttcttatggtagcactagaagataaatacaatgattttacacaatttattaaaagaatattaacttaaaataattttttactctttactcatggatacgtatatacccaccatacatattttagagggtatttatcagaatttgataattatatcttggctgtattgtcttcgctgagttttgtctagttgaatactttatgtttatatatacctgtattcatatctattcagaatctggcaaagcaaacctgagaaatatttttcatatgattaatgaaggacatactttgtgagttgcctatgctaagaaactttgtttttaatggtagttgatgtttcagttctgaataataattcttttggaagccacgctatttgaaagataaacttgacagaaaattagtaattgtaacctattataatgttcattgaatttgtattgagcattatttcttccatcaacttgtaagttatttacatttaatttaaaataggttgtcaggaaaattattttaattatgaatatccttttaaaattgtataaatatttcattcatctattagagttgccataacaaagtatcaaaggtgacaattagtattttagagcaggattgcttctaaatctctttcaaactagatcattttcaatacccagtgcattacactctgttgccattgtacttctttgggatgctcaaattagtttcaaatctcactaagaagctggtttctgtgtgtatttcacgtgcccccattaagctttcgcataacaaaaggttccaggctttccttgacttttcctactacacacccagttctaataacttctctatgaaactccagtgccttctagtgggagaaacgatttttagaaatgaacctaaactatgaaaacctcacttcaggttcgaaaatgtcgtttattaagaaaaagaatttttggccagtcatggtggctgtaatcccagcaatttggaggccaagtcggggagatcacttgaggccaggagtttgggaccagcctggccaacatggtgaaacactgtctctactaaaaattcaaaaaattagccaggtgtggtggcaaacacgtgtaatttcagctactcaggagcctgaggcaggagaatcacttgaacccgggaggtggaggttgcagtgagccaagatcactctactgaactccagccttggcgacagagcaagactgtctcaataaataaataagtaaataaaatgatttcctttagtttacgtctctttcttccttggactaaatatcctgcaatcataagaaaatgtaagagtatctcaggatgttacacagagcagggatggttagattttccaatacggaggagacactcagcaaaaaactgtgcatccgtgcttgacggactgggtcagagaagctgtcatgcgtcacccaacaagcctctggagccagttctgtaactagcaaacgcctcccagaaagtaaagatgtcacttctctgaacttagtcttctcatctacacactaaagctgttgtgtcactagcctccttccagttctctctgatttatgatgattcaaacttaatttttctttagttatattcttaagatttcataacaaatagaacgtaaatattaatttctctcatgtttcagaattataaagaacttgatataaagaaacttgtttcaaaattataaagaaacataaattatttgctatttaaattgtggtagtgttcaatgttctctttgtatatacatatacatatataaatatacatatagaatgtatgaatatatatgtatattcgtgtgtggacctatatttttatatcaataatatgtctcacctgatacatgaattctaactatggtaagaatgtatgccatctaatacaaacaaaatgccacaaaactcaacaaaatgttttatttctggagataatttgctacatttcagattttttcttatgttatagtaatatttcttttctctattttccaaaaaacaattattgctaatgtgtgcacctgaactgacagctttagcataacttggtatagttttagataagctgagtttaaattaacgc

SEQ ID NO: 1738 - DNA, 4937 bp, Homo sapiens
aaaagagatctgccttaacgaagttctacaaattcagcagaggatagattactgtggattaaaataaacaatcagggaaagctttgtagagagggtgacgtgagctggacttaaaagatgtatagaatatgaatagaccgatgtgatgtaaggccattcctggcagaggcacagaggaagaaggggcacagcctaagtggaacaattaagtaaacaagaagaccagagtttgaatgtgtgagtgagaattggtgacagcagacaatggagggtcatggatgctggttcttctattaatagtcctccatatccatcttctcgggcttgggtaattttagtagcctctgcgtctctctcttgtgtcttgttattatggcccagtattgcacactactcctaaagtcccgtcctgtcgctctgttggttaagaatctctagcggctcctcctgccaaccacatcgaattcaaacctcattcaagctcagctcacttgagaccagacgttcgggaccagcctgggcagcacagcaagaccgcatctctacaaaaaataaaataaaataaatagctgggcgtggtggtgcacgcctgtagtccaagctacttgaaaggctgaggtgggaggattgtttgagcccaggagttccaggctgcagtgagccaagattgtgccactccagcttaggtgacagaacaaggccctgtctctaaaaagaaaaaaaaaaaaggttaaaaaaagtttgtaaaaacagaggaaatgttagtcattttctctgaggggcagaattttcttttgatttaccagtattttctagttttttcttaagtgaatatgtattactccatactaaagttattaataaaaaactgatttagtttttctctctgtaaaatgaggattaagacatagtatagaagcatggtgagacatgaaaaagtatagaaggtgattggctagagtcaactgactgtggtttgcagcttctttaaaattagcttaggagagatacatacatttcaaggtcattgaaaataatcatggcatcttcttttaagaaagttcaggctaggcatagtggctcacacctgtaatcccaacactttggaggccaagaagggaatcaattgcttgaggccaggagtttgaaagcagcctgggcatcataaggagaccttgtctgaaagaaagaaagaaagagagagaagaggagggctactaaaaaagaaagttttctctttctactttcctggatctagattcaaatgaaacagaaagaactctaacctgcagcagaaatctgaatctggggtccttggatgagctcctgaaattgtatgctaatttgcacatgtgcacacttttcaggagaaaattgttggttttaaaagaagttaagaactaaaatttaagacctggagagtctttcttctttcagaggattttgagacacagcccttgcttccagtgctaaggccacttatattggacagttttacaactgaacaagttaaaaatgacagtaaggaacaaagatcaaggtactacttttatacagaaacactctgaagtgcaatgtgtgactgattaaaaaattaccagaaacaaataatacattccaagtggatgttatcttatatgaaagttctttgatgatcttgattggtagatctttggaatttccttcagtgctcgagacttgttaatgtgaattacttcaatgatggcaaatttgggttgaatttgggttttatcattttgccaaatgttacctaaaatgaatacctgtgaataaagaggtaaccaagtttgggcagatacccattttaggctgcaaatgagtaaagacaaatcacaagatgtttcttggttgatttacttatttgacttttaagcacttccaaaaacatccttaacaacggtgacatcaccagaataagtatgtaactttcaaaggcaactgctttgaaagataatagttaaatatacttaacaaatatggggctctttataggcaaacctcctatgcacatactagttttcatctaatgtgctatatataggcttactttttgtattgcatccctttagacttgtaatgcctgttagccattattcttttcacctcagttaatttcttctttttattctgtgaaactgccaggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacaggtacatgcctattttctagagataaggctttgtctcatctgtaagattagtgtttctttctcatcttattcccagatagatggagaccctcaccctgcaccaaaggagtaggccaggaggattgtgtagccattctcatatccagcacagacaactgaaatatgattacctggacactgatatccctttaggcactttggcatttgtttgagaaaatgtgttttcaggcaatgaaagcaaaaccccagtgtatcataggtacttttcagatgattagcattactttaatttccttagagatgaaaagaactgttggaagaggataaatgacagaagactttttttgtttttaggagacctattatctgtcttgaaaataactacaaaaatgagtattggggaagctaatagctcatgtatagataatgaaaagcttttgaaagccatcaatccagataatgatcaatataatataaaaacccagtataggttagcagtcaacaaggctggctggaggaaagatctaaagtgggggccctgtgctttgtagtaacattgactgagaagtctgtaagtgggggaagtaattataaaccaagggagatcattgtcctgtttacaagccacttgttaagccacagactttaacatttcatgtagggaccgggaaaccaagaggaacatcaatttaaaatagccagggccagatctcagagctagaaaaggtcaaagaggtattttatctgagctcccttccaatgcagcattcagagcttgacttccttggcaggtggttagatgtgggccttgaagagacagcccagactcctaaacacagggtgatcagcactgttagtgacatgatctcacttccagatggctagttcccatctagcatgatacccaaattctcctatgatattggacacgttatttttattttaactagcagagtatgacttcagtgttccctgccagattcgtgcaatcatcctggtgtcccatgtaatgcagcaaaatggtgtcaagttcatgaaagcgtaatgaaatggtagctgtaaagctagcctatattggagttgccaccaggtccacagtctctgacatgtttaatatctgagccctttgcaatcttcctctgtgaggagatgctggagaagctcaggcctctttctcttcgctggtaatttcagttctctctagatgagaatagcttaaagtctctagattccaattggttaaaactcaaattttaagaacaatgcaaaaaggggaaacatacctgaaaaaaatcactttgtcactcttaaaattattttctttccctcccaatgtctgttttgtcacagcagaaaataatttaccgcaaagaagtagagggaagaccagaaggtaaagtgaatggtaattcttcttaatcgactcggctcgaggagcttgtggaatccctttccagaagctttaccatcacagctctgtgactgtctcccagcaatactgactgcagtcatgtgacctggcccagcccaggacttctctcattacagctgccccagatttgggccaatgtccgtctactctcctggttttactgtaaataagtatatcctgtgatgctctgtctttccaggccatgtggtatgaaaagtcttaacctcaaaggttaaaagacccaggttcaactcctggctctgctatttacaagcatggagcaagttttggacacatagtgagttcctggcacacagtgagcacccaagatataatattttccctcttttcatcatttagttaatttcaagcactcccagatcagatgtcctgacctgtctgaagatcaacaatgagccaggaggtgtgagctcaggcttctggcttcgccagtcctgaccagtggggacccattcttctcttgcttttccctcctgttcacagctcatcttgcattcctttctccagcttctcaagtccaaatctcatttggggcttgtagcctctgatgggagcccctctgtctctggacctttttgggtgcacatattctctcacaaggccccctactcttgccagtgtccttcgcattcctctcgccccactcccatagacccctccactgtcagagctgttcagaaatacccaggggaacaagggtgctgctgccggctgccagtgagggccagctctggggcatcgcaacctgtgggctgttgctattacagtagggcctaaacctcatggaaagacacagccatccaagcagtcaacaaagtgtttaaagtcttaaaatgctcttggaaaaagaaaagttagattgtaatcacatgcaacttattaggccctcaagaggtatggattctgttatgcctccgctacatttcccacccctgcgactccagttcccttgttccagcctcagaaggaagggcctaggacactttacagggctggtgggcacagcttgcaaaaatggctgtggagcccacgcacgctccacgatcctacttgttataatacttggcctcgggctacctttgctttgtgctattctgcaggaagagttttatcgctttgacaaaagtgttattcttttatttatagtttccacaa

SEQ ID NO: 1739 - DNA, 16696 bp, Homo sapiens
gtctgaactgtggttgttgctgctataggagtcgagactgagaccaccggtcagggaatgggagccagcccaggggctcggcgtgcaccggccatggcgggggctgtgcaggaggcggtgccgagcgagagcccggcttacttgggatagaaccgaaagtcccgcgccgaggtggtcagatagagctggcggcggttcaggacgccccggtcggatactgtgaagggtgggccagacagcgcggggttcttcgtgcaggcgattagagcctgagcaagattgggggaggaggcatacccaagacatagatttcataccccatcccaagtcctgggtcccgagttcagaatccctctccttcggcctcgacagccatgacggccacggccctcacaccccgccccagggtcagagcccttcctgccacccacgccagggaacttcagcttcctttctcatacccgaacccttcccagcctcacctccctaaatccaagccctcctgctggtcaaggaactcaaatgcaggcccccagccaccacaaaatccccctggttctgcccccggtctcaagccttcttggtgtggccactggagctgagctgcatcttgggcaacaactccaggttacctctcctaactcccaccctaccacgtctcagaatattctagtctcctccccacccacagcccgccgtctagctccgcagcagcttaggagccctgaaggcgagtttccagcccctggtccttctggcctggcgtggatgcccagcccttcctcccgctcctctaacctcccgatcccgccccagatcctttagccacgccccaaagctgtgatttccttctggccccgccccaggctcccggagctccgctggtctcgccagcgccggcttccacccagacacctgggaaggccccccgcggtggtggtccgagagttgtgaggggctggggcccgacgtatttgggggcgcgcgcgtccgggccgggagagcaagtgtactgcgccctcgtctcgctgctctggtactttgtggtcagtaggagggttcagctgcggtgtctgagctgcggaaaggcaacccagagactcatgtgaaggagcaggggactcaaatgcagtcccccgcagactccggcgctccccaaatcttaccttttctcctgaatccttgatccccacagtccgcgtggggtctgcaggctctggggctctgggctgggcgcagggcccgccatgggtcttgggcacgtaggccgagccagaggttgtctcccatctgctgaggacctcgtcgaaagcccagatgcgagaatcctgctttgcagtcggaggtagagggtccgcgaccgtggactggagagaaggcgccgcacatcagctagaaagactcaggagtccctatcaccccccaccccaaactctgacctcttccagtcggcccccagccctttcctctgcagtccctggcatccaaattccctggcgcctcctctctcagacccaggactccaggaccctcctccttcagagaggagtccaagctcccaatccccttttctcagcccccatctttctgggtccccaggccccgcagggcttcagcctagggtctgcccacctgcaccgtgggcggggggaagggtacgggtgggataatgccatgggtaacgtagctgctggtgagatgccagttgggccaggattcaggcatctcggttgcagagatgaaagaccacggggggccacagcgcacagccagggtgccactggccatggttccaccccctccctgtagccaagcaggagctggtttgttgctgttgccccaggtgacagaacccgcccaccccaatccagccaatgaaaggcctgcaggcacatggatggatggagtgattaagagacccagagacagagagacagggactccaagaggggcacagagaaacacggagtgggggatggagagtcagaaagaggcggacagaaggggatggagaagttcaggatttcagagacccagggggtgggggagacagagacacagaaagaaggacagagacctgggggtgtcagagatacagacagagacccctgcactgcccccagcacctcaggacatccatgagaaacacccccctttgctccagggtccagaacctcctggctgcttcctccctctgccaggcctgcccacctcggggtaacgatttccagatgtccccggggctccccaacccttcccgcacgtgctgaaggagtcagcgctggtgtcagctgtcctgcctgcctttgatttggttgaaaacttccacctgggtaggctgggtggggaaagagaaagggatctagagagaagtgcaccggaccatagcgaaaaagatgggctttgatgagtgaggaataaatacaacaagaaaggggagagacagggaggaagaaagagaccacgatggaaagggagctattagtactacccagaggcgacagacactggaagttagagacagagatgaaggtggcaaaaacgaccaaagtcacagatggaaaacaaggagacgtagaaactgaggcagccacgccccaccctgcccaggggcctggtctgtatagatgcggggagaagttgcctatgtcctttgctcaaagctggacctgagagagagagagagagttggtggggcgatgggtaacatgtgaagggctattgtgaaggcctgtggtctgtccctggcttcccttgtcacttcttcactataaacagcttttgatcaccgggcgcagtggctcatgcccgtaatcccagcactttgggaggccgaggcatgcggatcacttgaggtcaggagtttgagaccagcccggccaacatggcgaaaccctgtctctaccaaaaaatacaaaaagtagccgggcgtggtggcgcacacctgtaatcccaactaaggcagaagaatcacttcaacccgggaggtgaaggctgcagtgagctcagatcacaccactgcactccagcctgggtgacagagcgagactccatctcaaaaaaaaaaaaaaaaaaaaaaaaaaaaaaaaagcttttggtcaaggcctctgactgctcaacccccattatctcatcctaccagcccattctgcagacaaggaaaactgaggctactttctgcagccatgcccaggatcccacttacccctcctcccccattcaggcttctggggcctttctgttggattttgctggccctactcaacagctctcaatggacagtgaccccctgatcctagccagggggccgatgagttagtcagaaactcatgccccactcaagctggacaaaatttttttcttttttttgaaatggagtttcgctctttttgccaaggctggagtgcaatggtacagtcttggcttactgcaacctctgcctcctgagttcaagcaattctcctacctcacccttcagagtagcttggattacaggcatccgccaccacgaccagctaatttctttatataattttagtagagtcgggttttcaccatgttggccaggctagtctcgaactcctgacctcaggtgattcacccacctcggcctcccaaagtgctgggattacaggaatgagccatcgcacctggccatcaagctggaaaattttaaggtctgtttctttcccaatgtagagtaaaggttgggacagggaagagggctagaaacctgacttcagctccctgccgagggctgaactctccagcatcctgatcacttctcattcaaccttgcttgtactcctctgtgatcggtagcttattacctcaaaacagaatattctaagtcaacctttgccccctcttaccaagtaagatttcccatttgaaccccatctcccagatacttaaaggccttctgtgggccacgttctcaaggtcccctggccatctgcttgcctgttctagtttctctcctcctccacccacatcgtgaaatgtcccctcccactccccagcaaggtggtgtcctctgagactgagtagtcagcaacttaacaccaagggccaccaatgatcaaatccatgagagttgatctgaggagttatgtattagggataagaaacagtaaacactcagtaaatagtggctattattattatatcatcatcattattaccctcaagttgctccaggagaactcctattcaacctccaaaaccccatgtggtttcacccatcctgcagagattgagctcaaaatcagagaattgtgattttgtgattatttgatgagttcccaaactggggtccttagatcagctgggccatccctgaggtctctcagcatccagctctgttattttcctgggcatgggtctcaggcccggccagtccggctgaggagtgtgcagacgcaggcagtgtcaattcgaatccatcgccagcccacacggccctgggcatcagcggtcaatgcccgcacataggactgcttggccttgcactcagatacccagtgcctcctgtccactccccggcagccccctccacctgcccccgggccaccttcctcagcgttatcagccttgcagcgggtttcaaagaagtactggcggaggggactgccgccagctgcaggcacctcgcccaacacctccacctcgcgcccacgcaagtccacagcggtccggcggtctgtcacccagccactgactgcatcgcacacagccagctcaccccgacgactcgctggtgcagtttcgctcaccccacgccggctgcggttggccggggcacctgctgactcccgaaaggccccagcctccagcaggaagagcagagggggcccagcaggggcacccctagacaggactactcggggggagagaaggtcccactcaggggccagaaaagggggcaatgttgagggtgggggttgggactcaattggcacactggggaggaggaaaaggaggaggatggggagggagcatgaggggagagggagcatctctcggagcacctggagacagaaagagggaggctgggattagagaagggggtaaaaacttcagtggggaaagaagttgggaaccccaggggaggcttgcctgccaggattgtggggaagcccttgttctagaagtttgggggaccctatatctagggcttgcgtaatgcgcaacttgtagattaataataaatattcaactactacaggccaggcactgtgccccacacctctaatcccagcactctgggaggctgaggcaggtggatgacttgaggtcaggagttccagagcagcctggccaacatggtgaaacctcatctctaccaaaaataccaaaattaaccgggcatagtgctgcacgcctgtaatcccagctactcagtaggctgaggcaggagaatcacttgaacccaggaggccgaggttgcagtgagcagagagtgcaccactcccctgccacctgggcgacaagagtgagactctgtctcaaaagtaaaaataaggccaggcatggtggctcacacctgtaatcccggcactttgggaggccgagatgggcggctcacctgaggtgaggagttccagaccagcttggtcaacatggtgaaaccccttctctactaaaaatacagaattacccgggtgtggtggcgcatgtctgtaatcccagttacttgggaggctgaggcagggcaatcacttgaacccaggaggtggaggttgtggtgggctgagattgaaccattgcactccagcctgggcaacaagagcgaaactccgtcttaaaaaacaataataataataaaataaaaataaaaataattcaactactattacttaacagtaacagatgttgaaatacaggctcagagaagttaatgatttgtgcccggtcacacagccagcaaatggcagagatgggacttcacctctgggcaactgcactctgccgtccttcctgtgcaactctgaggaaccgacagtcttgcatcttggaggatgttccaaacaattttttttttttgagacagaatctcactctgttggccaggctggagtacagtggcacaatcctggctcactgcaatgtctgcctcctgggttcaagtgattctcctgcctcagccttctgagtaggtgggattacaagcacctgccactgtgcccagctaatttttgtatttttaatagagatggggtttcaccatgttggccagactggtcttgaactcccaacctcaagcaatagtcgtgtcctggcctcccaaagtgctgggattacaagcataagccaccatgcctggtcccaaacaaaatttttttttttttttttttgagatggaatctccctctgtcgcccaggctggagtgcagtggcacgatcttggctcactgcaagctccgcctcccaagttcatggcattctcctgcctcagcctcctgagtagctgggactacagactcaagccaccacgcctggccacattccacaatttagagaaaggtcacaacctggaatcctagggagaccccagttcacctcaaaactgccactaaggaggtaaaacgctgcccctctgaggcaggcttcagtttccctgtgtgtgaaattgacctggcgctgggagaggctggtggaggcgcggattttgcagtttccctacaacattctggaagcctgtggttctgggaaagggtggcgtggagaagactgggaaacagtcagtagttaccagacctgtcagcacctcctccgcctcggagctctggggctgggagtccccaggcttcggggggcccctgtggaggacacaggtggccccctccttcctgacatctcaggagagggagggggcaaccacctaggggaagaaaagaatagacaggttatagaggcaggtggggaaggggccaaatccctgaacaaccccttcccagagttcctcttcaagtgcagggtacccaagagtcaaggccccgccccctttccagaggccccttttctacccaggtgatggctcctggctgggatgggaagcagatggagggaggggaagggagaataggggaagggagaggcagtggatgaaggaggctggaagagattacatccccctcggcccattcatctcccagatggggcggaactggcctggacacccgggtccctgagggcccacactcaagaagccctggttccccaagctgcttcctggaatgttccctcctcacaggacaggccagggcccgcccaagacttctgcacatacctggagtggctgcctgccctggctcctcggtacaggaaaggggaagggtggagagtgaaaggagcccaggctgacccaaccaggaccgccttctccctcagaccgagtagtgcagaccccagggcctccaccttcagacccaggagttcagatccccagcgccctcctccctcagacccaggagtagtccaggcccccagcgccctcctctctcagacccagaagtccaggcccccagcacccttctccctcagacccaggaggagtccaggcccaggcccccagcacccttctccctcagaccctggagtccaggtccccagcgccctcctccttcagacccaggagtccatgcccccagcgcccttctccctcagacccaggaatccaggcccccagtgccctcctctctcagacccaggagttctggaattcaggcccctccttctcggatactaagaaatgcagactccgggttcctcatcctccagatttgggttgggggttccggactccgagacccctcaggggaaaccggctgcatatctgggacacttccctcttgcctcagtttcctccgccaagccccgccccggtcggccccgcccccgtccctccccacccgagggcagggcgaccaggacgccggaatcccgagggaggaggagtggagatcttacctggggcgccctcttcggctcccgcggctgccctccgcccggcagcagctcctcctcctgctcgctggctgcagggacgctcgctggcccgccgggtgctagctgctcacgctccgcagggcccgggtcgggggcgggggcggggcggcgccgggcggcagaggaggggccgggggatcctgccttgcactcgcgtgccgggaccttggaagccaggcctggctcgttcaacgcggccgccttggtcacaggagtcccagtttccagctgcctcctcctttggacctagcagtccaggcccccagcccctcctcccttcagacccaggagtccaggcatccggcccctcctccctcagacccaggacttgcgaccccagccacctctccccccagccccaggcgcctgagtactaagcccacagttccccccaccacctcccaaccccgccccgtctcagactcaggagtccagcccccagcctcctcctccattagccccaggagtctgggcctgagattcctttgccgtcttttgccaattgcgtgtcaatcccggggcagattcccaccctctgctctcctccccacttcccaggagctccacgccagacattaaccagctgggcttgggcagtgataaggccccaggcccggggagacagtggatgtgggggctcccgcatactcctctcccctggaatttcctggctggggaccggggagaaggtcttgtcctgagctcagataagagacgtgcaaggtatcataggaccagagatagacagatgtgtcttaagaacaatcagctaccttgagaaatggtgcgcggtgacatgaagggagagatagggagaagacatggaaaagtggggagagaccaaaagaaagagggggaccgagactagagagagtgggggagggcaggagcccagagagaagacagaggcccagagagcgtgagggcagacccccccacccccccgagaaggggacagagcccctgagagaccctgagaaagacagggatgggaccggagccggagtgtctcaggacagtcatgagggcagcggggctcctcaccccaccacacctctaccctgagactccgctcccctccgcctgcgctattttcagaaggaaaactgacacctgcctcgagggtcatcccacaccccctcagcctaaatatagcatggcaaggtggcaggagggtgtccccggttagggtgtttcctgctcctcaccatcccagccaaggcaacacacaaggccgctccagttatttattgggggtggggggaagggccacttcccaggctttgggtgtgcattcaggtcacctctccggcttctccacccttcccctgttcctaaacagccaatacatcctgccgcatagcaggaggactctagcttctagcttctagcttctagtcctggaggggatagtagggatgaggtttccaaacagagtgactgggaaacagtctctgtccccctatctccaggtctctgttcccctccctctggatttctgtctccctccaactctgggtctgtccttctctctctgagtctctgtccccctctctctctgggtctctgtccctctctctctgggtctctgtccccctctctctctgggtctctgtccccttctgtctgtgggtctctgtccctctctctctgggtctctgtccccctctctctctgggtctctgtccccttcactctctgggtctctgtctctctctctgtctctggatctctgtcccccctctctctgggtctctgttcccccccaggtctctgtccccccttctctctgggtctctgtccccctctttctaggtcccagttttcttctctctggatatctgtccaccctctctgggtcccagtctccttcttgctgagcctcttgcatcctctctcttggggtcactgtctgcttctctttcccctcgtgggggtctctgttcccgctcccggccatctgccctcttcccccttgcccttggatttctctcttttgctctgtgcctctcctccctcctggcctcagttcctgtctgtgtctcctctttaggtctctgtgctggagtccaacctgtctcttgtcactgtgaggtccgtctccattctgtccctaaatctggctttctctccatttcagagagaagtgactacctaaagcttctattaatttcaaccattatcaaactcctctcaccatctgtaccttctctttagctgtatgaaaaggtgctcagatgaaaccaggggtttccacactgaattcctgagctgcattttgagttgccaagaggaggcgtgttctcctccaaccagttcccttcccatgcttcccactggtgtctctaaggaagatttatttgacccaaaaaaggggtgggtatggctaaaaataacaacaacagtctgtaaaccactggataggttttaataaattaacccaagtaaagtactttgataccaaaggaagccctatatgtgttagtgatttcagccttcttcctctaaatgccctttgagttctgaaagatttctgaaaatgttcggccttgtgaccttgggtaacacctgctgctctgagcctcagtttccccgtctgtaagaaatgaggctacgggactcaggaggacccgtgtgtcccagcaggctgatggggacatgtgaagcagacagacagcctgcctggcccctggggacaagctgtgagaccttgggaagccactcccctgctctgagactcaggtttctcccctggaaaacagagtgaggcccccagcctgtctgacagccttcctgagctgcagggagggtaggtgacaggcctggttcaggattgttctgtgattctatggaatagactgtacatcactcttgggttcaggggcaccaactttttctggctttttcttttcttttctttttttttttgagacagagtgttgctctgctgcccaggctggagtgcagtggcgcaatctcggctcactgcaagctccgcctcccaggttcatgccattctcctgcctcagcctcccgagtagctgggactacaggtgcccgccaccgcacccggctaatttttttgtatttttagtagagacggggtttcaccgtgttagccaggatggtctggatctcctgacctcgtaatttgcccacctcggcctcccaaagtgctggggttacaggcatgagccaccgcgcccggccttttctgcctttttctattgtggttctctttccctgagactctgttgttctgtctccaactctgggtgtctgacgctgccctctgggtctctgtccctccctcccccactggctctttttgtttgtttgttgagacgggggctccctctgttgcccaggctggagtgcagtggtgcaatcatggctcaatgcagcctctacctctcagggtcaagggatctttctgcctcagcttcctgagtagctgggatcacaggcatgtgccaccacactcagctaatttttgtattttttgtagagatggggtctcaccatgttgcccaggctggtcttgaactcctggcctcaatcaatcccccttcctcggtctcccagagtgctgagattacaggcatgggccacttcgcccggcttctatcccctgctcttggtctctgtctccccactctggatttctgttcctctcttctgcgtctctgccataccccaccctccaggtcattgtctccctctccctgagtctctgtttctctccctttgggtctctgtctctctgggtttccacctcttcctttttctgggtctctttctctatccttttggctctgtccctctatcatgtctggacagagtacagttttctccccctctcccctttcccttgtggctctgacctccatgtctgagcataaaactgtaggggagaatgggagtgaacagcacaatgaagtggatgtggggtaaacaggaggagcatccacctcttcctaatttacccagtcgcctctggatgaacacccaatcccatggatacagaatccagtcccgccccctacagcgagctggggagccagctcggcacacctcccagagccctcgccactgcatgctcccagatacatgatgcttccccactgctatttcctttgggtcctggtgctaccactaaatgcaaaacagcccgatgtggccctatggaactcgttcgcacagtccaactcaacccaacttcctgtaggactcacatagtgacacaactcaatggaactcaattcagcatggccctatgagactcaaacagtggcatgacccaactgaactggccttacaaggctcatatggttgtacaattcaacacaactcaactcgctgtggccacgaaaaatgtccagccacacacctctacacagttaagcccaacagaaccctacaagattcatttggtcatacaaacttaacccaatgtgacctagaaagctcaaattctaccactggactcttcacatttctacatgactcgcaagttcacagaacctaaaataacatgcccctggaagaatcacagagctacacaatttccaccatgtctcaacgaaacttaacaccacacacattcgatctcaacaatgccatgggggaccatctaacttgacccaacatggccctaggggacccaccaaaccacagaatcctacacaatgcagctggaccacactatcccagactcacaacccaaccaaacccaacactgacctaggaaactcacaaaatgatacgaccaaacctatctcaacactaccccaaaaggctccatgagctttgcacaactcagagtaatatgaaccaattgagtcttcattaacacaacacaacccattgccattcgctgctgcttcaggaggtacccacaggagctaccaaaccacacaacccaagacccaacaagactcagtgtttccccactcgttacgacttaacctagctcttcctaaacccaatcccctccccccagccttgccctccaccctgccctccctccctccctctagggaggtgtgaggtcctgcagacctcaactgttcctcacacttcggtgaccaggtgtttccctgggggtgcccagagtggaggtggtagctcaggtacctccccgtccaccagccccccattggccttgccctccagtgggccacaaggctgcatgtccacatggctgaacatcccagcctcttcgccctctgtctcccggtgataaaagtagctgaaattggagacaatgacgggcactggcagggaaatagtcagcacgcccgcaatggcacacagagagcccactatcttgccacccacagtgacgggtgccatgtctccatagccaactgtagtcatggtgactaccgcccaccagaaggactcagggatgctagtgaaatgggagtccacccggtcaacttcggcaaagtagacggcgctggaaaagaggaccacaccgatgaagaggaaaaagatgaggaggcccagctcacgcatggaggcccgaagcgtctggcccaagatttgcaggccctttgagtgccgggacagcttgaagatgcggaagacacgcaccaatcggatgactctcaggatggccagtgacatggcctgctggcccacccctcgctgccgggccagctcggtgcccagtgccacaaagtagggaaggatagccacaaaatcgatgaggttcatcacgttcttgaagaagatagccttgcttggacagaccaggaggcgtaccagcagctcaaaggagaaccaacaaatacacagcgtctccaccacgaagaacgggtcattgaagggcaggcggggtggatttccaggcatttggctggagccattcagcggagcggggaactgcagggaggaaagtgttcagggagggtcaggctggggctaggacacggggacagccttaatcatcatttaaatacccagctcctctttacacattggtcagtagccgctgcgccaaggccctccgtgacctggttatcccagacttcctcccaggatcccagggatcatccctgggccgctgactttctggttgcctgacctggtgggtggctggagacgtggtccctgccccttcatgcgtgggaactcatgtttgagtagggtgcaacctcttctctctcaaagtcccgcctccagtgttgattttctagatggggagcatccctgccctggccccaccaccttgtgcctagcttttccttgccctccacagtcccagcccagagtataatgcggctgggcgcggtggctcacgtctgtaatcccagcactttgggaagccgaggcgggcggatcacgaggtcaggaaatagagaccatcctggccaacacggtgaaaccccatctctactaaaaatacaaaaattagccgggcgtggtggcctgcacctgtaatcccagctacttgggaggctaaggcaggagaatcgcttgaacccgggaggcagaccttgcagtgagccgagatagcgccattgcactccagcctgggcgacagagcaagactctgtctcacaggaaataaaaaaaaaaagaccttctctgcaagccgagccctaggccccctcctctggcccctcaacctggctttctttccatagattcctcctactgtcgcccctcgggctccagcaccctcagctggagttattcagggcctggctttcaccacccagccgcacagactccggagttttcaggctctccttggcccccctcagctgtgatttttaaggttcctgtcctcctaccccttgcatcaagggccctgccctcttcacgccgggtttctcactgacctcaaccccaccttctgatggggcaggtcctccgacccggatcctcaggccccgcctcccgcccaccctgtcttcggctggcccacccctcgcagcccctggccccgccttatgattggccaggtcccctctggaccccgcccatctcctcccaaaccccgcccgtctccacccacgccccgcctctcaccgggccggctgcggctgcagcagcaagccccgtgccgtcgcggtcgtcgcggaagtcaggcagcgtctcgaggcagaagacgacgatggagacgaggatgaccagcacggagactacggcgagcacgcgcgcggcctgagagctctcgggaaactcgaaaagcagccacagctggcgggcgaaggcgcggcggggcagggggcgctcgggcggcaccgggcagccctcgtcctcgcgcaggcgtgccagggccgccgcgcccagcccgtagaaggccacctcttccaggaagacgtcgagcggcacgtgcgccggccgccgcagccgcccaccggactggtagtagtagagcacggcgtcgaagctgggccggtgccggtcgaagaaatactcgcggcgcgcgtcgtcgtagaagcggccgcggcgcgctgggtcccctagcagagtgtccgggaagcggcccagcgtgcgcgcccgcgtctcgaagcgcagcccggccacgttgagcaccagccgctcgcagcagccgcacggcggcgggcaccgcggctccatggcgcgcgcagccccggcgacccgcgaaccgacgtgtggccccgacgcccggccccggtgcggccccgcctcggccgcctcggccgccgccgccgccgccccagcccggtgtccggtgtccggtgtccgcgcgtaaaaatagcccggcagggcggctagggcgcgagggagggggcactgtgaccccggcggggcggagggcgacagggcgaccgcgcgccctctgccgggacgcccgccctgccctgccccgccgccgccgccgcccgcgcctgctctgcgcctttcccgtcccggggtcccctttctctccgtccttctgccgccgggatcctgtcctgcgtctctccaagtttccgtgtgcgtgtgtttcgtcagaatcaggcttcagttgcagtcgcctcttttcttttctctttcttctttctttctgtctttttttttttttttttttttgagacacagtttccctctgtcgcccgggctggagtgcagtggcgcgatctcggctcactgcaacaacctccacctcccgggatcaagcgattctcgtgcctcagcctccctagtagctggaattacaggcgccaccaagcccagctaattttttttcttttttcttttttagttgagaaggggtttcaccatgttggccaggcaggtctggtactcccgacctcaagtgatctgccctccttggcctcccgaattgctggggttacaagcgtgagccacggcgcccggcctggagtcgccctgtttgcacctttgtctctcactctcttgtgtgtctgtgtccggctgtcccctctgggtctctgtctcttttgggatgtatctctgagtatctctatgggtcatttatttctgagattcgtcgttctgggggcctctgtatgggtccctctgccagcctctacgtctcggtctccgcctttattttgactcttggtctgtctccgtttatctcttgtctctcttggtctctttgtctctcctctctaggtctctttttgctcattatctcttagccctccatgtctctgtctcagggttcctcggccgctcccctttgggtctccccttgggg

SEQ ID NO: 1740 - DNA, 49702 bp, Homo sapiens
ggcagatgtaattaacaataagcacagtataaagtcttagcatggcagtttacatagtcatagaatgttgcaatagttaacatattggttagatattacaataaagtaacagtggatttaataaaataagaggattatttcttctctcatagaagtctgagctggtaggtggtccaaaggtggtaggtggtaggcagctctgctttatgagtttgtacaggacccagataccttctatcttgttcaactaccatctagggttgaagatgactcactaccaccatgtccaacctccaatttgaaggaaaatggaaaggggaaagttgaaccaacagtacctttatgaaggcatggcctgaaaatggaagattatcacttctctttgcatcacactggcaggtaattggttgcttggccacatgtagctgcaataaaggctgggaactgcagtctctagttgagcggggtatgtttagctagagtttggggtgttattgccaaggggaagaagagaagaatggatagtggtgaacaattagtcaactgtcatagatgtttatctctatcatttgatcctctcaacaaccttgttagaaagcaggcacagattatttaccatcctcatttttgcagatgagaaaattgaggtggaagattaagggactccatcaatatcatacaacgaagccacatggcatagtgggacaactgcaaaaacttggtcaggaggtgccctggttgggcacagtattaaccactgagttttctgaaatgtattcctcagcctgggaacagaatttcccagtgcttgcagcttctttcaagaaaaagcttcccggtaatcacgggttagaggtcggaggagcacaaattcaagggcattttgaacatggccccacatggatgtgatctggctaacccatctttttttttaaattatttattattattattatactttaagttctaaggtacatgtgcacaacgtgcaggttcgttacatatgtatacatgtgccatgttggtgtgctgcacccgttaactcgtcatttacattaggtatatctcctaatgctatccctcccccttccccccaccccatgacaggccccagtgtgtgatgttccccaccctgtgtccacgtgttctcattgttcaattcccacctatgagtgagaatatgcagtgtttcgctttctgtccttgcgatagtttgcccagaatgatggtttccagcttcatccatgtccctacaaaggacatgaacgcatccctttttatggctgcatagtattccatggtgtatatgtgccacattttcttaatccagtctatcattgttggacatttgggttggttccaagtctttgctattgtgaatagtgccgcaataaacatacgtttacatgtgtctttatagcagcatgatttataatcctttggatatatacccagtaatgggatggctgggtcaaatggtatttctagttctagatccttgaggaatcgccacactgacttccacaatggttgaactagtttacagtcccgccaacagtgtaaaagcattcctatttctccatgtcttctccagcacctgttgtttcctgactttttaaagattgccattctaactggtgtgagatggtatttcattgtgcttttgatttgcatttctctgatggcctgtgatagtgagcattttttcatgtgtctgttggctgcataaatgtcttcttttgagaagtgtctgttcatatcctttgcccactttttgatggggttgtttgattttttcttgtaaatttgtgtaagttctttgtagattctgggtattagccttttgtcagatgggtaggttgtaaaaattttctcccattctgtagtggctaacccatctttgcctcttccagtccaagcacagacaatgagcagagaggaggacaatgtgggttaatggaaagaacactggattggggtcaggagaccccaagaacattgaattggagtcatttttagctcacatcaattgcatgcctgtgaagtgacagctactgagcttgacactggcatgtcttctcatttaatctcagaacaacactgtgaggtagatgttactatgtatatcttacagaagacaaaactgaggcccaaagagctgagtggcccaaagttatatagcttgtgagaggtagggctggaattctaacctagaccttctgactgctaaccccaagcccttctacaaaatcatactgttctttacgccaagtaactgctgggcaagctggaactgaaatgggatatgtcaccagtcacacggatgacccgtaacacgtctacctggggcccaggtacttaggttgtgtactttgtgagtctgctttttgtgtgtgaaggaaacccgtatatcagaggttggatcccctaaattggccttacccacacattctgcttgatctaccttctctgggctatgcttttttctttgttaattttcttctcttttcaaaattgctgaaggaatgtatgttcataaaattcaaataatgtagaaaagtcagagatcaattaggatgcttccctaacctctctaactccttttccagtccctttccagaggagaccactttcagcagtctggggagcacctttggatgtttcttgtctaagcatttatttttgtcaagatttttaaaaagtaaaaatgggaatgtgtgtgctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaacctccataaattatttattgtaagtatgtttgataaggattgtacagctgagagttcaaggttgcatttttttccccagcaagaaccaaaagtgcagataacatgcagccaattaaggacaaatctgtatggtttgtcaatcaatctgtcaggatgtccctgaattgtagcacttatcacttggtattatagacatctgtgtccctggcataactgcatcctcttcaagggcaggaattgcttcttttccatttttgcactctagcatccagcattatgtttgagacctagcatctatatgagagactttgttgaacggaatcaattgaaaggcttcccattatcatgcagtactacttgacaaagatcagaaccctgagcaatcaagggcaggaaacataggctagctgagctttgaaggaagtgaaaagaaaaagaggcagcaaagatgggaacatggaggacagtctgagaaaacaagctcagggttgaagggggtgttccagtgaaggggtgatgagtgggacctcacacatggagcagataacattggtgcatcagttgatttaaatgagcagaatggaaagtgtctaaaagagagatgtggaaatgagtagaaacatccctttcctgttgggccagctattgtctatggttagtccttttcccatccttatttcctctcctctgaattgcaagttgctggaaacatgagaagtgcattccttgctcccttggttactgggcttcagttagcatttgccaatgagggtgagcactcatgggagactggaaagtggtagaaagggaaagccattcagctggctgtgacagtggcagcagcgggcagtaccgtgggctccaacagcattggtggtggctccagcatcatcactgggagcttgggctcctgggttcctgctcagcagctatggtcagtaccttctgagatggcctcctctgatcctcacctcttggtattcatggccttgtgaaatcccctttgcttgagtaacttgctgccaaccaatagaatatggcaatgttgagggttgctacctttctgactaggttgcaaatgattgtgacttctgtcttgctggcaggctctctctatttgccttttggtttgtgtgctctgaggatgcaaactgccatgttcgtgagacctgcatggcgaggaattgagggcagactctgtccaacagccagtgagaaactgaggtccaacagcctacacggagctgaatcttaccaataactacatgaacttgaaagtgtatccttcccttcagatgagtgtagcctgagtgacaccttaactgaagcctatgagaggccctgaagcagaggaaggacccagctagctcacacctagatttctgatgcatagaaactgtgagatagcatgtgttattttaagccagttttgagatgatttgttatacaatagcaatagataacaaatatgatggcagagctctgttccaacagcagtagcaagcgtgtgcttgccgactctggatcactccacattcacctctttgcttctacagctatgggacaatagcagcagcgtcctacagttgccaatttctaggtaatgccattttccacttgacctgtgttttcaaaacctttgtcaccattttcctatattaaattccttcataataacagaagagtggctaacatatgcacacaactatttttcttgatagggagataaagagagcattgctgtatattaaatgtagttatgtctttttagatgtttaagaaaatgaaatgcaccttttttcaagtgaataaatgtttgcctctctgtagttcttggtttttgggagaaggtcaacttcaaaagatagagtcattggcaccttctttctgtagtgtgcttgactgtatatccctgcccacccacaggcagcaaaggcaatgcatgagggattttgaaggacacacagtagctgcttctgttttcatgtgggagtccaaggaagtataaatgctgcatgctccctgtaactagaataaaatattatggtgtgtgtataagggcaaactcctaactcagcaggtgaacaaccatatcgacttcattccccctggagactgaaattagaaagaaacctacatatcaggccacagcagcccttgatgaagctcaaaagagaggtggcaaactcacagctacacagcaaaaaccaagtcagaggcagcaaaagctgtagtttgagaacaaagggaaagaaaaagactagtcaaagaggccatatctacccacccacagaaaacccagagaagaaaataagttacatttctcccactggaaggcttgggggaggagacattcaggaaagccacaggggcagaaaattagatagtttatctgaaaaaggaaaaatgaactaaagtgtgcttttgatagatggctggaagtgagcacaaaggcaaaacaccaacatacacttggcgtctgaagaatgtcttttatccaaagatcttagagcagtttgagtgtattaatttacttgtgagacagttaaattattattcgttcatttttatgtggcattttattctaaaatttgctaaggattttataactcaagtacattggttattccccaaacagccctgtagatgcagtgtggccattactgtatgacacatgtggacactgagcctcagagatgtcaggaaacagagagaatcagaggaggctggaagatcagcgatgactgtatgaacactgaataaggaatggggaactctgtggagacaactcagtcttttctatggctatttcttcatggcttctgtggtagatagaatgatggtcctccaaagatgtccacatcctaactcgtggaacctgtggatatgttatctaatatggtggaaaggactttgcagatatataagttaagaatattgagaggggaaaattctcctgggttatctgggtgggcccaatgtaatcacaaagatgtaagggagagagggagacatgagagtcagagaaggagatgtgatgatgggcagggattgcaatgatgtggggccatgagccaaggaatgtgggaagggcaatggaacacgttcttcatctaaaactggaaagggtaaggttacatcttctcctctagagtttcttgacaacccatcttagacttctgacttatagctgcaagatcataagtttgtgatgttttaatccactaagtttgtggtaatttgttatagaagccacagaaaactcatacagcatctttgaggagtggggggctgcactgtaaacctaaaattttattttttgagttatttgggtaacacaattttagaggattttttttaagaactgtttggatatgtattaataacaattatgggtttagtggcttgaaggaaaaatacagtggcagtaacaacagcaatagtaatgggttatagttattaaggttgtgtgtgccaagtgctgggtaggggtgtggatgttccttctctctcattttctaaaacaattatatgggataattaccttcattttacagaggaggaaactgagtctgagagagccatgcaattagtggtggagctggcatttgcacacaagcatatctgactcttgactacgacctgaagtggtttttctatatacttaattcattgatgggaaaggacaagtcatgtgtgaaagcagggacatgagcaggtgatgacagaaagttgagacaggcctccggtggcactggggatgtgtattgactctgcctcagccatgacagaggtgagggacactgtctcctttccgtcttttctcttctacccatgccagccagccacttttataaagtacccaccatcggtgggcagcacttttccccattctttcttgccaagtgtgactcttctcttgaaagaaagcacacaatttcacactgtataatgagtgtctttcctgccagaaacaacaaggatggagaggctgtggggctactttagctgccataagttagaagggggtcaagtgagtgggatcaggaggatgtaagatgagaagaccaaaattttaatgagatgctgctggaatcagcataaccaagtatggtatcagagctgaaataacttaaaatattacaagtgccattgtaaaatgcaatactccctacttcctagggtggctgtgagaatggagttaataaatgcagagtgctttggatggtgctatagaagtgtagctgttactccactgcacccatcccgcaactactcctgctgctaccagcgccctgttattatcgccactgccaggattactaccactatcacaattactcttactactgccattgactacctttgctaccatcacattatttcaactgctaccattgctgctgctattactactactgtaccgttgctatgacaattattaccattactactgttactgtcaatctgtaggcatagaaagtgcttctgttgtaataaataggccaacagacttctgtaccttcaacaagggtggctagagcacatcctcaggtcatcctgggattgcctggcaatagttcccagtctgattcttttctttgggctgttggcattcttttgctactgctcaggtttggacaaagtggctgtcattgccccaagctctctgaggtaggaactctgcctgcttcactaattcttctcagtgacaaatgctcctcaaatctattccccagtggccatttgaagtggacaaacaactccacagccatgaaatatcatgttttaaatagaaggcactgtgtcaaatgccaccagcaactcagccttggagctgctgatctcagactgattcagattcttggagataatcataagaactaacctttaacaagtgcttattgtgtcttatcaggtgctgttctaggcacttaacaaagatttaattatttgactctccaaaaaagtcttcgaaatagttactgctatgaattatgttttacaaatgagaaaactgagacacagagaagttaagacatttgctcaagataatacagcaaatgggaaagctgggatttgaacacattcagtctaactccagagatgctgctgctggccaatgtaaaccaacacattggcttcacagtacacagcattttagtcagagaagatcaaggcctagcaaagacagctgcccatagttggtgctcaataaatgctagactagtgaaggaatgaatcaacaatgaatggaagaatgagagtaacatggtgtttgtgtgagtgaagaaagaaggcagtatgagtattctaaaccaaacagtcaactcagttattgtcaagaacagattgaaaaggaagtcaaggtagtcaagaaggaattgataaggaattatgcatagagacctggtttgctggaggatctagggaattgtctctaaggattttccagggcctggggaagacagttcagtggagggaggtgggaggacttctagaacacttggccttttcttagaccaggggtccctgaacccctgggccatggactggtactggtcagtggcttgttaggaactgggcaggacagcaggaggtgaatggaaggtgagcgagagaagctacgtccatgtttacagccacttgccatcacttgcattactgcctgagcgccacctcctgtcagatcagcggtagcattagattctcataggaacatgaaccctattgtgaactaggttgtgtgctcctcatgagaatctaatgcctgatgatctgaggtggggctgaggtgatgatgctagcgctggggagtggctgcaaatacagataaacattagcagagagggttgactgcccacaataaatcagttgcttgcagactcatatcaaaaccctatcaatgtgtggcaaatgaccagccgcatctggtggcaggctttatagtggcaagtgagttgaaaaaaagtgcacaataaatgtaatgtgcttgagtcatctcaaacccaccataccccttacctctttcctgtggaaaaattgtcttccatgaaactggcccctggtgccaaaaagttggtgactgctgccttagacctttctggtgtacctcatgatatagttccagtctctacaaccagtcagcacctttctctgatgcagagtgatttgtttgcttcttttagttattaaaaattgtgtgtcataggattttagtgctagaaatctctctagaggtcaagccccctcatttcactgattaggatactgagtcccaaaggggttacgggtcttgacaaggccacaacaatagggatttgctaggccccaacatgcacctttaattctgattcattcatttgttcaccccaatctggtgacagtctcttgtgttgtcttgaatgtcttggtatttcagataaaaagcctggcttaagtttttgatcatagccattctaacaggcatgtcatgaaaaaagacaagagatgaatgtggacgaggtcgtagagaaagggagcccctacacactgttggtggggatgtaaaaggtgcggccgctataggaaacagtatggagtttcctcaaaaaattaaaaatagaactgccgtatgatccagcaattcctctgctgggtctatacctgaaggaaatgacatcagtatgttgaagaggtatccgcactccagtgttcactgcagcatgattcacaatagccaagatatgcgatcaccctaaatgtccatcagtggatgaatggataaagaaaatgtgatattgtacaaactggaatactattaagccttaaaaagaagaaagttctgtcatttgcaacaacacgaatgaatctggaggatattacgctacatgaaataagccaggcatagaaagacaaacactgcatgatctcactcatatgtgacatctcaaaaaatcgacctcacagaagcagggaatagaatggtcattgccaggggctgaggggctggggtggaaataggaagatgtcagtcaaaaagtgcgaaggttcagcagctagaaaatgaatcatttctggagactagtgtacaacatggtgactaccgttaatatgcattgcatacttgaaaattgctaagggagtagatcttaaacattctcactacaaaaaataataagtatgtgaggtgatgaatatgctaattagcttgattgtggtacaatgtatacatatatcaaaacatggtgttgtgtgccttgaatacatacaatttttatttgtcaattatactttaatgaggtagggaaagaaaaaaaagaagggagagaaagagagaaatctaaaattaaaaaaaaatggaaaaaaggtcggcttgggccagggccataggcaaactttgtttttcataacactggatatgacaatgatctaattagctaattaatttgcactgtattcttttgctacaacgtcatataactttcgtctttaagatggacaaactaaggtaacttgcattttccttcatttaatatttaaaacctctttataagaaaaagcagccccaaagaattgtttgtactcatattaatatcacttaattaaaaacatttttcagcattgtaacaaatagaacaaccttagctgtaatatatgttcttcttgcagcaaagttttgcctctttacaccatcaataaatgtgagcattataagattataataaattatttagattatacttacttttaatcattattttctcagtaaattctaaaattcaatgcaaaaggaactaagatgacttagttacatatgtttcacactggactcattatagctttctgggagtgactatgttactttattaaaaatttcttttacctttaataagggagaaagacagagaccattatgtcatctagtttctcattctgtcctgcttagcatataacttcttcattattgtactctccatagttcctcctgaatagaaagtatcaaatctcctcttcacgtcttcactgtaattatcattcttatctgacataaaacagtgattaaagtaacccatctctagaactaatttgatatataacaataaaaacttcttgacaaatttcaatgtcatctgggtggtttagatatgtacacactctgttattgattttccctcctttgataatacagcactacttatttttaggttttctctaactcaaaaggaaaaaaatgctgtttttattcttactctcactaaacgcttttatttaaagtgtaagtgaccatttggtagaagtcacatagattgtgcaatattttaatccaagtgagcaatctggttctaataccttttgcttgtgggtggggacacccatttttgctacttcaatggcctacaattcaacctgatcccaagacttttgctattcatctctcctcccgcatttagctgttccgttattccattgttatattattgtgggatttatatgaattagcacagaaaatggaactcaagtgttcagatttaagcctctttctttctttgtagagcccaaggcagagaaaaatgtagatccaggaatctttttcttttctttgtgacattactaaggagatgctatttttccattttataagtggaaatattaaggcagagccaacttcggggacttgcttcaggttatatagtcaatctgggttgtagtcaagaggaacaaaacataaaaataaaagttggtgaaataaagaaactgatggccccaaacagtattagctgaaattgctagtataaaagaactcaaggaaagtttaagtaaaattgtggttgattgcactttaataggaacttaaggacatttaggagttgtttctaagcttgtgaggccttgattatgaaggaagttgcaactatttcctacaaaatgcctcttggtactattgtcagacagttggtctaagccagtgtggcaattcttactttattatgtttccccaagccccttttggtgttttatctagtggagcattcatctgagacaaacagcttatgtactctttctcgccaagcagaagctagaatgaatgagaaaatcgcataagaaaatctgtcctcctgatttcccacatgaaactggcttggagagtcactgttcccttgacaggagccttctgcaggctccaccaatacttgtcaaccgcctggcttgttgtgggggtggcggcagctgctacttctgcttcttcaaaataaaaaccgcaaataagtatatttagaaagtgtgtccatcctagttcatcttcccagctgttttcctggtggaattagattagcagtgtaagtgaaatcttttctgaacctcatcgaaatccagacttgcctagtaaatggcttcattcattattttcatttacctacattctaatttagtttttcttatttttatgaacagttactatataccaagtactgtgcaaaaggctttacagacaatatctcatttaatctcaaaacagccttacaaagtgggtgttaccacccgtatatggcaacaccaggtttaagtgactcacctaggtcactcagcagggtgtcataatctagtctggctgattccagggcctatgttccaggatacgccatggccccagctgaggactttattaaatagtctatggtcttgcagagtcaaacctattctctggttcttaaagatggaccacttgaaggcaggtccttgaagagccatgggcactgacagtttttgctcactagggattggtggtaatgtctcaggttttctgtgagttcaattttcatgagcccagtttcgcttcagtaagtattgatctggccctagaactcatggtttgtgtgtgtgtgcgtgtgtgtgagtgtgtgtgcgtgtgtgtatgcacacctgtgttctctggcttggagagttagcaattactgatgatcagggtttccttaatctctcttaggaagacttcttagtctttatttatttggaggtcaaattgtgtacagtatttctcccagagattccttcttaattcaacaaagggaatgttttagaagaaaacaaagggaaaaacaatcaacaccaatccccaaacacccatatacatgcacatgaagaaaatgtgcaacatagctagagatgcattatcagagcacagattaattatttgaagcaaggtagactattagtttctgttagccttgctgggacttatttctgagcttctaattctagatatgagccccatgattacctcctttggccctgcttaggccctcttccatctctacagtcactctggttcctgggcaagtcttccttaatgcgcaaggcatttctcactgtggttccatgactcctgtctggaatacgggctatctggtctacttgcagtctgagtgacgcttaacttctttactcattggcataaggagtggctgagtttgctttctcttgaggttctggagtcccaatagttgaagaattcatcctcggagactcttcgctccagtccagcttcctgccatgcagcaaaagcctgcatttcttctagtttcaagcctttgcatcacctgttagatttcttactatgttcctccttcagccttaaaaggtatctcttgtgctcatttgtaggactggagttctaaaagaattctgccctggtaccaatcattccacctccctagttactctatgggacttactccagttgaaaccagtagaaaaatacctcacacatacagtggcaatagtaaacatacaagagaaagaatattcattttctatatgcctttctcctattttataagatataaaataagaaccttgaatgacaatgagcttttgggggaacatactttattcccacaggatgttccctgttctgggcctctcacattcatggacatctcatacatatgggcatcaggtacgatactttcagttgcaagtaacagagatcaactctgactctgaagctggtatagtggaggctgggagatcatgtctagaaaatgaacatgaaccagagagtcaagaaacacaagaatctggccacaccactgctgtggtcatgctgatgccatgaatgcatttaaacaagactttgtctttgcttcaccttctgcaaagtcagatgagtgagaacatctgataggcagggcttgatatgtgtcagccttgcctatcaggtcatgaagacaggacggatcacgactctttggcttcctctgtgggaacctgtgggaagcctgtatgcccaggggggtttgtgttcctcaaaaccaggctggatgtggtggctcacatctgtaatcccagcactttgggaagctgaggtggaactcctggctcacttgagtccaggagctcaagaccagcctgtgcaacatagtgagaccctgtcttaaaaaaaaaaaaaaattagttaggtgtattagtgcttgcctgtggtcccggatacttgggaaagtggaaagattgcttgagcctgggagtttgaggccacagtaagctgtgcttgtgccactgccctttagcctgggctacagagctagaccctatttcaaaacaaacaaacaaacaaacaaacaaacaagaaagggggcaggttgactgctagactgccatagaaaaatccaatggccagttcaatgaattttcctcagtatttaaaaaaaaaatctcaattagtttttcttaacactattctcaatctagccctccctttcgttcttttcaaaatatataccttttaggttagcagttgccttaatactgttaacattttataccgagaccacagagttgctgctaaagtgtatagtcagaattgaattcagaagattgatgttctcttcaggctgcagaccatctgattactggatctcctctgggcaatgaagctgcctcctttttctcctctctcgaccgtcaagcttgcaccacagtaataatatttaataagagcagcagtgaaactatgtcattgcttctctgatggtcagagtggaacacagctccaaataaaacaggagtgattgtcatacagataatacagttgttttagttctttcaccttgagaaaggatgaggtagcttgaatgctgattgatgcttgtctctcatagtctactggaatatacattaggtatttgggtgaaactgtgagttgcacttgatcatgtattaaacattttgcaagctatttgctgctgtatattctgactggatcttgaaaaacacccttgctatttcaggataaaagaaataaagcttttgtggttttggctgctctacctaagtcaggagactctttttctgagaatatttaaacattttgccacattcatctgtctttttctcacactatcccagaataactgaagatatgtaatacagggaaaccttattaaaaaaaaaacttctacctaaagaaatctgaatttatataacagaaaaattgtggagagattatttatattaaaaaagattttcttttttttttcacaaaagtgttcacgttaggctttctttaaatagcaaagtcccttactggattaaaatatgactgaatttctctttcagaaatgcatctactgtttaaaacaagccatgttttatgtcatccaattttataactgaagaactgagaataattcagaaaaaagtcacagaaactttgtgtggatctaggaagataattcagggctaacgatcactcctatactctcctagaaagagagtagcttccatggaaatgaactgagacccttccttcctagaacctggaagattcctgcattaagtcacgtcatagtcataaggtcattcaactattgatgacattttctaactacgtgtggataagcttttatgttgatggttcagattttctgctttggaaaaaaggaattttagtgtatttgacttctaacaataaaatatatgcaaagaaaagtctgtcattagattccctagtttgtaatttaggggaagatatttcacttcaacctttctgggccttagtttcttcacttataaaatgaaggttttgaactagataatctctgagtccttttatagctcccaaacttgcttcttagttgtttcttttatttttaaataagagtaacacaaatcctgtaattctgagagtctagatcacagactgatctcatctatgctttatcttttcattttataaatgctcttggtgtttgtaaagcttatgtccagacttgaagccagttagaggcctaaagaacagtgcaaaagaatgttagatatacctggatactcttcctcttctttttaaaaaaatttaatgaggaacaaaatcttagattgttacacagcagaggtgcaataaagaataaaaatgcaagggaggaaaagtcacaaagccaatgaacaaaaattcccctgtggtgagggtcttaaagcaggtgtagtggtttatcattttactgaatgagctctgggtctggtgggttaaaacaagatcctctggttaagtgggacaatgaaacatagatggggaagcaatagccctgctaaagactgaatatttatatcccctcaagttcatatgttaaaatctaatctccaatgtggtggtatttggaggtagggcctttgggagtgattaggtcatgaggatggagccctcatgaatgagattagtgccctaccaaccagggagctcacctaaacatctgtgtccagagcttttattggggcttcattatataggcatgattgattgaagtattggccaaaatattgaatacaatctccagccctcctccttataggtcaggctaatatcacatggctcaaagcctcaattctctaatcacatgattggtctttctggcatgaccagcctccatcctgagtaatctctttggcttaagctattataggcgtcagaagtcacctcattagcataaaccttcagggcccaccatgaataacaaagacactcatgtcactctggaaattctaaggatttagaggattccttctaggaaccagggaatagaaccaaccaaactctttattatgtaacatattgcttttggcttttgtctgttctgtagcttttgtaaggaatatgactagcaagttgttaaatctctctctttctctgacgagacttcaagactgaattgaagtcattaattggtttagagtcagagtagcagaatggttaacagtgtgggtttggagatcaggctgcttgggttaatcttggtttcacatcttactagcttggtggtcctggacaagtttcttaacctctctaagcctcagtttcctcttcagtaaaatgataggttatcatgatgaattaagctaatgtctgtaatgtgcttagcatggtgctgggcacacagaagcagtcaaggtttgctactaacgattgcgttaggattttagaaaagctgttgactatttctaaatgtttactttctaaaggtggcatgccctaaatatattcaggccagtggttgtatcagatttttagtttttaggcactgattctttgttaaaggaaatctttcacaaaatccgaatctagaaagccgatgaaatctatattaagctgaactcctctagtcaaagagggtcaggcacatctagccaccttttaatctctggggaattaagatctgtttgaggaagttagtttgaaaactggtctagaccacaaccagtcacctcaccttcaacctcccctccaccagctcccatagcagggttaacagagcaaatctgtgtgtgtcaaagtcaggctataattttcttatttcagtttctccatgagcaaaatggggaagataatgccagctttgttgtggcagtgaattagataatgtctgtaaactattttgagtctttagagatcagttttagggacaaagacctttgccatctttaatttttagcttactttaaaaataagatatcctaaacacaccacttaaaaatgggtcaaacagtcgttttgtctattcttgggataaggtggaagcaatgatttaatcaccacagaagaaatgtgctctgattaattgggaagaaagattttaaaattagagttattcagaaagcctgtcaggagaccaggaagagaggaaaggatgtgtgtcaacacctacagaaagctgtctgtgaagctgggttataacctgatacttctggtcttccctgtaactaaatgtcctttgctgaggcctgaggcagacccttactctgggtttcctgttcctgtatgactagtttcagtcaggctttacgtagtcattctgccctgcagagcaatcacaggaggtaagaaggcatggtcgttaatagcatgggctatgctgttggacttgaatttggtcttgtttctatcacattctgtaatttagttgaaaaatggaaataacacctatctcaagggtttgttgcaaagactacatgagattatacatgcacagcgcttagtacagtgtctgatacatagtaaatgttcttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccacctcagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgagtaaatgttctttagcagctgtcattatcattttagagacagagtcttgctggcattatcttccccattttgctcatggagaaactgaaataagaaaattatagtctgactttgacaagcacagatttgctctgttaaccctgctatgggagctggtggagggaaggttggaggtgaggtgattggctgtggtctagaccagttttcaaactaacttcctcaaacagatcttaataggtggctagatgtgcctgaccttctttgactgcaatccaggctggagtgcagtggcgtgatcataactcactgcagcatccaactcctgggctcaagggatcctcccactactgcctcccaagtagctgggagtacaggcatgcaccactatacctgacttatcttttaaaacacttttttttttttttttttttttgtagagacagggtctcactttatttcctaggctggtcttgaactcttggccgcaagaaatcctcccacctaggcctcccaatgtgctgggattgcaggcatgagccaccgtgcctagccccatcagcagttatttaaaacatcattggtatttattatcattattaattatgtttgctatcatggatactaaatatctgcccatctagatctattaccctgatctaaaattctaagttctaacattaccaaaaagaacttgagaagaaatgcctttccatagccagaaaacttgaagctgaagggattttgatttgctcaaaggtattctgtgagtcctttttatctgtcttcatgatctggaccctatagctataagctttcatgtggggaatagtgcttcaaaatgaagtgaccatttacaatatgagtccccagtgcaatatccctccttgggtaatattaggtactatcttggctcatttcatcaatatcttttttgactagtcttttactgattgccccaagttgttaacttcagatgatacaattaaaacacaaagaaaactggttgcaaagaaaaactgcaaaattgttttaaatgtttttctttttttaattttaagagctttaggggtacaggtgttttttggttacatggttgaattgtatagtggtgaagtctgggattttaatgtacctgacacctgagtggtatacatggtacccaaaaggtagtttttcgttccttacctccctccgaacgtcctcctttatgagttttcaaagtccattataccactgtgtatgcctttgcatactcatagcttagctccacttatgagaacatgcagcatttgattttccatttgagtacatcacttaggaaaatggtccccagttccattcaagttgctacaaaggacatagcataaaaaacatcctttttggcgattgagtagtatcacatgatgtgtatgtacaccgcattttcttgatctacttgttgggctcttaagttgattccatatctttgcaattgtgaattgtattatcataaacacacatgtgcaggcaactttttgatataacggcttttgttttctttgggtagatactcagaagtgggattgctggatcaaatggtagttcctttagttctttaaaaaatctctatactgctttccatagaggttgtactagtttacattcccaccaacagtgtataagcattccctttttactacatctatctgggccaacatctatcatttcttgactttttaataatggccattttggctggggtaaggtggtatctcattgtggttttaatttacatttctctgatgattagtgatgttgaacatttttttcatgtatttttggccatttgtatattttcttttgagaaatgtctattcatatcacttgcccacttttaaatttaatcgtttttctttttttgctgatttatttgagttccttgtagattttggatatcagtcctttgtttgatgtaaagattttcccccagcccatagattttgtctgtttactctgatgattatttcttttgctgttcagaagctttttagtgcaattaagtcccatatatttatttatttaacattttgcttcatttgcttttggggtcctagtcataattttttttgcctaagccaatgtccagaagagtttttcccagattttggtctagaattttgatggtttcagttcttagatttaaatctttaatccagtcccctctcccctctcccctctcccctctcccctctccccacggtctccctctccctctctttccacagtctccctctgatgccgagccaaagctggactgtactgctgccatctgggctcattgcaacctccctgcctgattctcctgcctcagcctgccgagtgcctgcgattgcaggcacgtgccgccacgcctgactggttttcgtatttttttggtggagacggggtttcgctgtgttggccaggctggtctccagctcctaaccgctagtgatccgccagcctcggcctcccgaggtgccgggattgcagacggagtctcgttcactcagtgctcaatggtgcccaggctggagtgcagtggtgtgatctcggctcgctacaatcacctcccagccgcctgccttggcctcccaaagagccgagattgcagcctctgcccggcagtcaccccgtctgggaagtgaggagcgtctctgcccggccgcccatcgtctgggatgtggggagcgcctctgccccgccgccccgtctgggatgtgaggagcgcctctgcccggccgcgaccccgtctgggaggtgaggagcgtctctgcccggccgccccgtctgagaagtgaggagaccctctgcctggcatccgccccgtctgagaagtgaggagcccctccgtccggcagccaccccgtctgggaagtgaggagcgtctccgcccggcagccaccccgtccgggagggaggtgggggtcagcccccgccaggccagctgccccgtcagggagggaagtggggggggtcagccccccgcccggccagctgccccgtccgggaggtgaggggcgcctctgcccagccgcccctactgggaagtgaggagcccctctgcccggccatgaccccgtctgggaggtgtacccaacagctcattgagaacgggccatgatgacaatggcggttttgtggaatagaaaggcgggaaaggtggggaaaagattgagaaatcggatggttgccgtgtctgtgtagagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgacattccctccactattgtcctgtgaccctgccaaatctccctctgcgagaaacacccaagaatgatcaataaaaaaataaattaaaaaaaaatctttaatccatcttgagttcatttttttatatggtgagtgatagggatccagtttcattcttctagatgtggcttgccaattttttagcactgattattgagtagggtgtccttcccccagtttatgtttgtgtatgctttgtcaaagggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaggtcagttggttgtaagtatttggctttatcttggggttcttttttctgtatcactggtctatgtatacacttttataccagtaccttactgttttggttactattgccttgtagtataatttgaagtcaggcaatgcgatggctccagatttatttttcaagcttaggattgctttggctatttgggttcttttttggtttcatattaattttaggatgttttttctaagtctgtgaaaaatgatattggcattttaataggaactacactgaatctacagattgttttgggcagtgtggtaattttcacaatattgattcttccaatctatcagcaatgagatgtatttccatttgttcgtatcaactatgatttctttcagcagtgttttgtagttcttgtaaatatctttcaactccttgcttaaatatattcctaagtattatataatttttttggtagcaattgtaaaaggaattgagtccttgatttgattctcagcttgctcgttgttggtgcatagcagtgctactgatttgtgtacatttatcttgtaacctgagactttactgaattcattgatcaaatctaggagtcttttggatgtgtcattagggttttctatgtgaatgatcatatatcagtgaacagcgatggttacacttcctcttttccagtttgaatgccatttatttctgtctcttgcctgattgctccagccagaacttccagtagtatgttgaatagaagtggtgaaagctggcatcttcgtcttgttccagttcttagggggaatgctttcaacttttccccattcagtatgatattggctatgggtttgtcatatatgggtttgtcttattttgtggtatgttctttctatgcctagcttattgaggctttttatcataaagggatgttcattgtattgaattttttctgcgtctattgagatgatcatatggtttttgtttttaattctgtttatgtgatgaatcgcatttattgaattgcgtatattgaaccatccctccatccctgggatgaaacccacttaagcctggtgaattttttttatatgttgttagattcattttgctagcattttgttgaggatttttgtatctatgttcataaggaatattggcctgtgatttcctttttttgttatgtcctttcctggctttgatactggctttataggatgagtaaggatgattccttccttctgaatagtttgtaatagtttcaactattgagaaggagtaatattaataccagttcttctttgaatgtctggtagaatttgtgaatccatttggtcctggggctttttatttgttggcagattttaaaaattaccgattcaatctcagtgcttgtcattggtcttttcaggatttttatttcttcctgattcaagctaggggggttgtatgtttccagtaattcatccatttcctctagtttttccactttatttgtgtagaacttttcatagtagtcttgaaccatcttttgtatttccatggcgtcagatgtaatgccctattttcatttctaactgagcttatttgaatcttctctccttggttaatctagctagtgatctaccaattctgtttactttttcgaagaaccacctttttttttttttttctcttttagtcagagtctggctctgttgcccaggctggaatgcagtggcatgatctcagctcattgcaacctccggttcccaggttcaagccattctcgtgcctcagcctcctgagtagctgggattaccgatgtgtaccaccatgcctggctaatttttgaatttttagtatagacagggtttcaccatgttggccaggctggtttcgaactcctaacctcaagtgatccacccacctcagcctcctaaaatgctgggattataggcatgagccatcatgccctgcccaactttttgtttcactggtttttttttttttttttttttttttttttttttggttttcatttcattttgttctgttctgatttttgtatttcttttcttctgctagctttgggtttggtttgttcttggaaaactgcaaattttttaaaggaagcaagatttcatgaaggtgattaaagtgatattggggaactgttgaatcagtcattaatttaagaaatacttattgggtacctacttgggtgtccaaattgggtaccattttctaggtactaagtgttagagattaacgttgactattccagccttcatggacctgacatgccaaacttccataaaaccactggcaaatggatctggtgaagttgaaccagttaacaatcagaagagataatcaaaaatatgatgtgatagatgctttcagtggatttaaaacatttctgcaaattctttgacattcttcctacaaaaggtgaaacgtaatctttctctccttgaagatgggtggactttagaagtttgcttccaaagacgagagtttagcagaagtgatgctgtatgacttcacaagctaggtcataaaagtgaaatggcgtctgccttctctttcaggggcccacctgaagctgccatgctgggaagaccatgtggtgagatcagagagaaatggagaaagatgcttaaggagtgcttgttgttttgttccccagctgttggagtcttcccaggccagatgccagatgtatgagttaacaagccgacaggtgacaccgctcccagactgaccccatcagctgggacgagtggagaaagggtgagctattcccactgtgccctgctcaaactgcccatttttgagcaaaataggtgttattctaagccagtaagttttggggaaatttgtcacagagttattttccaataactggaaaaatgcctcaagtgagcatgataggaatatcaaaggattaatagagatccatgagaaaactgaagaaacctttgcatattttttgcagaaata

SEQ ID NO: 1741 - DNA, 46980 bp, Homo sapiens
ctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaacctccataaattatttattgtaagtatgtttgataaggattgtacagctgagagttcaaggttgcatttttttccccagcaagaaccaaaagtgcagataacatgcagccaattaaggacaaatctgtatggtttgtcaatcaatctgtcaggatgtccctgaattgtagcacttatcacttggtattatagacatctgtgtccctggcataactgcatcctcttcaagggcaggaattgcttcttttccatttttgcactctagcatccagcattatgtttgagacctagcatctatatgagagactttgttgaacggaatcaattgaaaggcttcccattatcatgcagtactacttgacaaagatcagaaccctgagcaatcaagggcaggaaacataggctagctgagctttgaaggaagtgaaaagaaaaagaggcagcaaagatgggaacatggaggacagtctgagaaaacaagctcagggttgaagggggtgttccagtgaaggggtgatgagtgggacctcacacatggagcagataacattggtgcatcagttgatttaaatgagcagaatggaaagtgtctaaaagagagatgtggaaatgagtagaaacatccctttcctgttgggccagctattgtctatggttagtccttttcccatccttatttcctctcctctgaattgcaagttgctggaaacatgagaagtgcattccttgctcccttggttactgggcttcagttagcatttgccaatgagggtgagcactcatgggagactggaaagtggtagaaagggaaagccattcagctggctgtgacagtggcagcagcgggcagtaccgtgggctccaacagcattggtggtggctccagcatcatcactgggagcttgggctcctgggttcctgctcagcagctatggtcagtaccttctgagatggcctcctctgatcctcacctcttggtattcatggccttgtgaaatcccctttgcttgagtaacttgctgccaaccaatagaatatggcaatgttgagggttgctacctttctgactaggttgcaaatgattgtgacttctgtcttgctggcaggctctctctatttgccttttggtttgtgtgctctgaggatgcaaactgccatgttcgtgagacctgcatggcgaggaattgagggcagactctgtccaacagccagtgagaaactgaggtccaacagcctacacggagctgaatcttaccaataactacatgaacttgaaagtgtatccttcccttcagatgagtgtagcctgagtgacaccttaactgaagcctatgagaggccctgaagcagaggaaggacccagctagctcacacctagatttctgatgcatagaaactgtgagatagcatgtgttattttaagccagttttgagatgatttgttatacaatagcaatagataacaaatatgatggcagagctctgttccaacagcagtagcaagcgtgtgcttgccgactctggatcactccacattcacctctttgcttctacagctatgggacaatagcagcagcgtcctacagttgccaatttctaggtaatgccattttccacttgacctgtgttttcaaaacctttgtcaccattttcctatattaaattccttcataataacagaagagtggctaacatatgcacacaactatttttcttgatagggagataaagagagcattgctgtatattaaatgtagttatgtctttttagatgtttaagaaaatgaaatgcaccttttttcaagtgaataaatgtttgcctctctgtagttcttggtttttgggagaaggtcaacttcaaaagatagagtcattggcaccttctttctgtagtgtgcttgactgtatatccctgcccacccacaggcagcaaaggcaatgcatgagggattttgaaggacacacagtagctgcttctgttttcatgtgggagtccaaggaagtataaatgctgcatgctccctgtaactagaataaaatattatggtgtgtgtataagggcaaactcctaactcagcaggtgaacaaccatatcgacttcattccccctggagactgaaattagaaagaaacctacatatcaggccacagcagcccttgatgaagctcaaaagagaggtggcaaactcacagctacacagcaaaaaccaagtcagaggcagcaaaagctgtagtttgagaacaaagggaaagaaaaagactagtcaaagaggccatatctacccacccacagaaaacccagagaagaaaataagttacatttctcccactggaaggcttgggggaggagacattcaggaaagccacaggggcagaaaattagatagtttatctgaaaaaggaaaaatgaactaaagtgtgcttttgatagatggctggaagtgagcacaaaggcaaaacaccaacatacacttggcgtctgaagaatgtcttttatccaaagatcttagagcagtttgagtgtattaatttacttgtgagacagttaaattattattcgttcatttttatgtggcattttattctaaaatttgctaaggattttataactcaagtacattggttattccccaaacagccctgtagatgcagtgtggccattactgtatgacacatgtggacactgagcctcagagatgtcaggaaacagagagaatcagaggaggctggaagatcagcgatgactgtatgaacactgaataaggaatggggaactctgtggagacaactcagtcttttctatggctatttcttcatggcttctgtggtagatagaatgatggtcctccaaagatgtccacatcctaactcgtggaacctgtggatatgttatctaatatggtggaaaggactttgcagatatataagttaagaatattgagaggggaaaattctcctgggttatctgggtgggcccaatgtaatcacaaagatgtaagggagagagggagacatgagagtcagagaaggagatgtgatgatgggcagggattgcaatgatgtggggccatgagccaaggaatgtgggaagggcaatggaacacgttcttcatctaaaactggaaagggtaaggttacatcttctcctctagagtttcttgacaacccatcttagacttctgacttatagctgcaagatcataagtttgtgatgttttaatccactaagtttgtggtaatttgttatagaagccacagaaaactcatacagcatctttgaggagtggggggctgcactgtaaacctaaaattttattttttgagttatttgggtaacacaattttagaggattttttttaagaactgtttggatatgtattaataacaattatgggtttagtggcttgaaggaaaaatacagtggcagtaacaacagcaatagtaatgggttatagttattaaggttgtgtgtgccaagtgctgggtaggggtgtggatgttccttctctctcattttctaaaacaattatatgggataattaccttcattttacagaggaggaaactgagtctgagagagccatgcaattagtggtggagctggcatttgcacacaagcatatctgactcttgactacgacctgaagtggtttttctatatacttaattcattgatgggaaaggacaagtcatgtgtgaaagcagggacatgagcaggtgatgacagaaagttgagacaggcctccggtggcactggggatgtgtattgactctgcctcagccatgacagaggtgagggacactgtctcctttccgtcttttctcttctacccatgccagccagccacttttataaagtacccaccatcggtgggcagcacttttccccattctttcttgccaagtgtgactcttctcttgaaagaaagcacacaatttcacactgtataatgagtgtctttcctgccagaaacaacaaggatggagaggctgtggggctactttagctgccataagttagaagggggtcaagtgagtgggatcaggaggatgtaagatgagaagaccaaaattttaatgagatgctgctggaatcagcataaccaagtatggtatcagagctgaaataacttaaaatattacaagtgccattgtaaaatgcaatactccctacttcctagggtggctgtgagaatggagttaataaatgcagagtgctttggatggtgctatagaagtgtagctgttactccactgcacccatcccgcaactactcctgctgctaccagcgccctgttattatcgccactgccaggattactaccactatcacaattactcttactactgccattgactacctttgctaccatcacattatttcaactgctaccattgctgctgctattactactactgtaccgttgctatgacaattattaccattactactgttactgtcaatctgtaggcatagaaagtgcttctgttgtaataaataggccaacagacttctgtaccttcaacaagggtggctagagcacatcctcaggtcatcctgggattgcctggcaatagttcccagtctgattcttttctttgggctgttggcattcttttgctactgctcaggtttggacaaagtggctgtcattgccccaagctctctgaggtaggaactctgcctgcttcactaattcttctcagtgacaaatgctcctcaaatctattccccagtggccatttgaagtggacaaacaactccacagccatgaaatatcatgttttaaatagaaggcactgtgtcaaatgccaccagcaactcagccttggagctgctgatctcagactgattcagattcttggagataatcataagaactaacctttaacaagtgcttattgtgtcttatcaggtgctgttctaggcacttaacaaagatttaattatttgactctccaaaaaagtcttcgaaatagttactgctatgaattatgttttacaaatgagaaaactgagacacagagaagttaagacatttgctcaagataatacagcaaatgggaaagctgggatttgaacacattcagtctaactccagagatgctgctgctggccaatgtaaaccaacacattggcttcacagtacacagcattttagtcagagaagatcaaggcctagcaaagacagctgcccatagttggtgctcaataaatgctagactagtgaaggaatgaatcaacaatgaatggaagaatgagagtaacatggtgtttgtgtgagtgaagaaagaaggcagtatgagtattctaaaccaaacagtcaactcagttattgtcaagaacagattgaaaaggaagtcaaggtagtcaagaaggaattgataaggaattatgcatagagacctggtttgctggaggatctagggaattgtctctaaggattttccagggcctggggaagacagttcagtggagggaggtgggaggacttctagaacacttggccttttcttagaccaggggtccctgaacccctgggccatggactggtactggtcagtggcttgttaggaactgggcaggacagcaggaggtgaatggaaggtgagcgagagaagctacgtccatgtttacagccacttgccatcacttgcattactgcctgagcgccacctcctgtcagatcagcggtagcattagattctcataggaacatgaaccctattgtgaactaggttgtgtgctcctcatgagaatctaatgcctgatgatctgaggtggggctgaggtgatgatgctagcgctggggagtggctgcaaatacagataaacattagcagagagggttgactgcccacaataaatcagttgcttgcagactcatatcaaaaccctatcaatgtgtggcaaatgaccagccgcatctggtggcaggctttatagtggcaagtgagttgaaaaaaagtgcacaataaatgtaatgtgcttgagtcatctcaaacccaccataccccttacctctttcctgtggaaaaattgtcttccatgaaactggcccctggtgccaaaaagttggtgactgctgccttagacctttctggtgtacctcatgatatagttccagtctctacaaccagtcagcacctttctctgatgcagagtgatttgtttgcttcttttagttattaaaaattgtgtgtcataggattttagtgctagaaatctctctagaggtcaagccccctcatttcactgattaggatactgagtcccaaaggggttacgggtcttgacaaggccacaacaatagggatttgctaggccccaacatgcacctttaattctgattcattcatttgttcaccccaatctggtgacagtctcttgtgttgtcttgaatgtcttggtatttcagataaaaagcctggcttaagtttttgatcatagccattctaacaggcatgtcatgaaaaaagacaagagatgaatgtggacgaggtcgtagagaaagggagcccctacacactgttggtggggatgtaaaaggtgcggccgctataggaaacagtatggagtttcctcaaaaaattaaaaatagaactgccgtatgatccagcaattcctctgctgggtctatacctgaaggaaatgacatcagtatgttgaagaggtatccgcactccagtgttcactgcagcatgattcacaatagccaagatatgcgatcaccctaaatgtccatcagtggatgaatggataaagaaaatgtgatattgtacaaactggaatactattaagccttaaaaagaagaaagttctgtcatttgcaacaacacgaatgaatctggaggatattacgctacatgaaataagccaggcatagaaagacaaacactgcatgatctcactcatatgtgacatctcaaaaaatcgacctcacagaagcagggaatagaatggtcattgccaggggctgaggggctggggtggaaataggaagatgtcagtcaaaaagtgcgaaggttcagcagctagaaaatgaatcatttctggagactagtgtacaacatggtgactaccgttaatatgcattgcatacttgaaaattgctaagggagtagatcttaaacattctcactacaaaaaataataagtatgtgaggtgatgaatatgctaattagcttgattgtggtacaatgtatacatatatcaaaacatggtgttgtgtgccttgaatacatacaatttttatttgtcaattatactttaatgaggtagggaaagaaaaaaaagaagggagagaaagagagaaatctaaaattaaaaaaaaatggaaaaaaggtcggcttgggccagggccataggcaaactttgtttttcataacactggatatgacaatgatctaattagctaattaatttgcactgtattcttttgctacaacgtcatataactttcgtctttaagatggacaaactaaggtaacttgcattttccttcatttaatatttaaaacctctttataagaaaaagcagccccaaagaattgtttgtactcatattaatatcacttaattaaaaacatttttcagcattgtaacaaatagaacaaccttagctgtaatatatgttcttcttgcagcaaagttttgcctctttacaccatcaataaatgtgagcattataagattataataaattatttagattatacttacttttaatcattattttctcagtaaattctaaaattcaatgcaaaaggaactaagatgacttagttacatatgtttcacactggactcattatagctttctgggagtgactatgttactttattaaaaatttcttttacctttaataagggagaaagacagagaccattatgtcatctagtttctcattctgtcctgcttagcatataacttcttcattattgtactctccatagttcctcctgaatagaaagtatcaaatctcctcttcacgtcttcactgtaattatcattcttatctgacataaaacagtgattaaagtaacccatctctagaactaatttgatatataacaataaaaacttcttgacaaatttcaatgtcatctgggtggtttagatatgtacacactctgttattgattttccctcctttgataatacagcactacttatttttaggttttctctaactcaaaaggaaaaaaatgctgtttttattcttactctcactaaacgcttttatttaaagtgtaagtgaccatttggtagaagtcacatagattgtgcaatattttaatccaagtgagcaatctggttctaataccttttgcttgtgggtggggacacccatttttgctacttcaatggcctacaattcaacctgatcccaagacttttgctattcatctctcctcccgcatttagctgttccgttattccattgttatattattgtgggatttatatgaattagcacagaaaatggaactcaagtgttcagatttaagcctctttctttctttgtagagcccaaggcagagaaaaatgtagatccaggaatctttttcttttctttgtgacattactaaggagatgctatttttccattttataagtggaaatattaaggcagagccaacttcggggacttgcttcaggttatatagtcaatctgggttgtagtcaagaggaacaaaacataaaaataaaagttggtgaaataaagaaactgatggccccaaacagtattagctgaaattgctagtataaaagaactcaaggaaagtttaagtaaaattgtggttgattgcactttaataggaacttaaggacatttaggagttgtttctaagcttgtgaggccttgattatgaaggaagttgcaactatttcctacaaaatgcctcttggtactattgtcagacagttggtctaagccagtgtggcaattcttactttattatgtttccccaagccccttttggtgttttatctagtggagcattcatctgagacaaacagcttatgtactctttctcgccaagcagaagctagaatgaatgagaaaatcgcataagaaaatctgtcctcctgatttcccacatgaaactggcttggagagtcactgttcccttgacaggagccttctgcaggctccaccaatacttgtcaaccgcctggcttgttgtgggggtggcggcagctgctacttctgcttcttcaaaataaaaaccgcaaataagtatatttagaaagtgtgtccatcctagttcatcttcccagctgttttcctggtggaattagattagcagtgtaagtgaaatcttttctgaacctcatcgaaatccagacttgcctagtaaatggcttcattcattattttcatttacctacattctaatttagtttttcttatttttatgaacagttactatataccaagtactgtgcaaaaggctttacagacaatatctcatttaatctcaaaacagccttacaaagtgggtgttaccacccgtatatggcaacaccaggtttaagtgactcacctaggtcactcagcagggtgtcataatctagtctggctgattccagggcctatgttccaggatacgccatggccccagctgaggactttattaaatagtctatggtcttgcagagtcaaacctattctctggttcttaaagatggaccacttgaaggcaggtccttgaagagccatgggcactgacagtttttgctcactagggattggtggtaatgtctcaggttttctgtgagttcaattttcatgagcccagtttcgcttcagtaagtattgatctggccctagaactcatggtttgtgtgtgtgtgcgtgtgtgtgagtgtgtgtgcgtgtgtgtatgcacacctgtgttctctggcttggagagttagcaattactgatgatcagggtttccttaatctctcttaggaagacttcttagtctttatttatttggaggtcaaattgtgtacagtatttctcccagagattccttcttaattcaacaaagggaatgttttagaagaaaacaaagggaaaaacaatcaacaccaatccccaaacacccatatacatgcacatgaagaaaatgtgcaacatagctagagatgcattatcagagcacagattaattatttgaagcaaggtagactattagtttctgttagccttgctgggacttatttctgagcttctaattctagatatgagccccatgattacctcctttggccctgcttaggccctcttccatctctacagtcactctggttcctgggcaagtcttccttaatgcgcaaggcatttctcactgtggttccatgactcctgtctggaatacgggctatctggtctacttgcagtctgagtgacgcttaacttctttactcattggcataaggagtggctgagtttgctttctcttgaggttctggagtcccaatagttgaagaattcatcctcggagactcttcgctccagtccagcttcctgccatgcagcaaaagcctgcatttcttctagtttcaagcctttgcatcacctgttagatttcttactatgttcctccttcagccttaaaaggtatctcttgtgctcatttgtaggactggagttctaaaagaattctgccctggtaccaatcattccacctccctagttactctatgggacttactccagttgaaaccagtagaaaaatacctcacacatacagtggcaatagtaaacatacaagagaaagaatattcattttctatatgcctttctcctattttataagatataaaataagaaccttgaatgacaatgagcttttgggggaacatactttattcccacaggatgttccctgttctgggcctctcacattcatggacatctcatacatatgggcatcaggtacgatactttcagttgcaagtaacagagatcaactctgactctgaagctggtatagtggaggctgggagatcatgtctagaaaatgaacatgaaccagagagtcaagaaacacaagaatctggccacaccactgctgtggtcatgctgatgccatgaatgcatttaaacaagactttgtctttgcttcaccttctgcaaagtcagatgagtgagaacatctgataggcagggcttgatatgtgtcagccttgcctatcaggtcatgaagacaggacggatcacgactctttggcttcctctgtgggaacctgtgggaagcctgtatgcccaggggggtttgtgttcctcaaaaccaggctggatgtggtggctcacatctgtaatcccagcactttgggaagctgaggtggaactcctggctcacttgagtccaggagctcaagaccagcctgtgcaacatagtgagaccctgtcttaaaaaaaaaaaaaaattagttaggtgtattagtgcttgcctgtggtcccggatacttgggaaagtggaaagattgcttgagcctgggagtttgaggccacagtaagctgtgcttgtgccactgccctttagcctgggctacagagctagaccctatttcaaaacaaacaaacaaacaaacaaacaaacaagaaagggggcaggttgactgctagactgccatagaaaaatccaatggccagttcaatgaattttcctcagtatttaaaaaaaaaatctcaattagtttttcttaacactattctcaatctagccctccctttcgttcttttcaaaatatataccttttaggttagcagttgccttaatactgttaacattttataccgagaccacagagttgctgctaaagtgtatagtcagaattgaattcagaagattgatgttctcttcaggctgcagaccatctgattactggatctcctctgggcaatgaagctgcctcctttttctcctctctcgaccgtcaagcttgcaccacagtaataatatttaataagagcagcagtgaaactatgtcattgcttctctgatggtcagagtggaacacagctccaaataaaacaggagtgattgtcatacagataatacagttgttttagttctttcaccttgagaaaggatgaggtagcttgaatgctgattgatgcttgtctctcatagtctactggaatatacattaggtatttgggtgaaactgtgagttgcacttgatcatgtattaaacattttgcaagctatttgctgctgtatattctgactggatcttgaaaaacacccttgctatttcaggataaaagaaataaagcttttgtggttttggctgctctacctaagtcaggagactctttttctgagaatatttaaacattttgccacattcatctgtctttttctcacactatcccagaataactgaagatatgtaatacagggaaaccttattaaaaaaaaaacttctacctaaagaaatctgaatttatataacagaaaaattgtggagagattatttatattaaaaaagattttcttttttttttcacaaaagtgttcacgttaggctttctttaaatagcaaagtcccttactggattaaaatatgactgaatttctctttcagaaatgcatctactgtttaaaacaagccatgttttatgtcatccaattttataactgaagaactgagaataattcagaaaaaagtcacagaaactttgtgtggatctaggaagataattcagggctaacgatcactcctatactctcctagaaagagagtagcttccatggaaatgaactgagacccttccttcctagaacctggaagattcctgcattaagtcacgtcatagtcataaggtcattcaactattgatgacattttctaactacgtgtggataagcttttatgttgatggttcagattttctgctttggaaaaaaggaattttagtgtatttgacttctaacaataaaatatatgcaaagaaaagtctgtcattagattccctagtttgtaatttaggggaagatatttcacttcaacctttctgggccttagtttcttcacttataaaatgaaggttttgaactagataatctctgagtccttttatagctcccaaacttgcttcttagttgtttcttttatttttaaataagagtaacacaaatcctgtaattctgagagtctagatcacagactgatctcatctatgctttatcttttcattttataaatgctcttggtgtttgtaaagcttatgtccagacttgaagccagttagaggcctaaagaacagtgcaaaagaatgttagatatacctggatactcttcctcttctttttaaaaaaatttaatgaggaacaaaatcttagattgttacacagcagaggtgcaataaagaataaaaatgcaagggaggaaaagtcacaaagccaatgaacaaaaattcccctgtggtgagggtcttaaagcaggtgtagtggtttatcattttactgaatgagctctgggtctggtgggttaaaacaagatcctctggttaagtgggacaatgaaacatagatggggaagcaatagccctgctaaagactgaatatttatatcccctcaagttcatatgttaaaatctaatctccaatgtggtggtatttggaggtagggcctttgggagtgattaggtcatgaggatggagccctcatgaatgagattagtgccctaccaaccagggagctcacctaaacatctgtgtccagagcttttattggggcttcattatataggcatgattgattgaagtattggccaaaatattgaatacaatctccagccctcctccttataggtcaggctaatatcacatggctcaaagcctcaattctctaatcacatgattggtctttctggcatgaccagcctccatcctgagtaatctctttggcttaagctattataggcgtcagaagtcacctcattagcataaaccttcagggcccaccatgaataacaaagacactcatgtcactctggaaattctaaggatttagaggattccttctaggaaccagggaatagaaccaaccaaactctttattatgtaacatattgcttttggcttttgtctgttctgtagcttttgtaaggaatatgactagcaagttgttaaatctctctctttctctgacgagacttcaagactgaattgaagtcattaattggtttagagtcagagtagcagaatggttaacagtgtgggtttggagatcaggctgcttgggttaatcttggtttcacatcttactagcttggtggtcctggacaagtttcttaacctctctaagcctcagtttcctcttcagtaaaatgataggttatcatgatgaattaagctaatgtctgtaatgtgcttagcatggtgctgggcacacagaagcagtcaaggtttgctactaacgattgcgttaggattttagaaaagctgttgactatttctaaatgtttactttctaaaggtggcatgccctaaatatattcaggccagtggttgtatcagatttttagtttttaggcactgattctttgttaaaggaaatctttcacaaaatccgaatctagaaagccgatgaaatctatattaagctgaactcctctagtcaaagagggtcaggcacatctagccaccttttaatctctggggaattaagatctgtttgaggaagttagtttgaaaactggtctagaccacaaccagtcacctcaccttcaacctcccctccaccagctcccatagcagggttaacagagcaaatctgtgtgtgtcaaagtcaggctataattttcttatttcagtttctccatgagcaaaatggggaagataatgccagctttgttgtggcagtgaattagataatgtctgtaaactattttgagtctttagagatcagttttagggacaaagacctttgccatctttaatttttagcttactttaaaaataagatatcctaaacacaccacttaaaaatgggtcaaacagtcgttttgtctattcttgggataaggtggaagcaatgatttaatcaccacagaagaaatgtgctctgattaattgggaagaaagattttaaaattagagttattcagaaagcctgtcaggagaccaggaagagaggaaaggatgtgtgtcaacacctacagaaagctgtctgtgaagctgggttataacctgatacttctggtcttccctgtaactaaatgtcctttgctgaggcctgaggcagacccttactctgggtttcctgttcctgtatgactagtttcagtcaggctttacgtagtcattctgccctgcagagcaatcacaggaggtaagaaggcatggtcgttaatagcatgggctatgctgttggacttgaatttggtcttgtttctatcacattctgtaatttagttgaaaaatggaaataacacctatctcaagggtttgttgcaaagactacatgagattatacatgcacagcgcttagtacagtgtctgatacatagtaaatgttcttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccacctcagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgagtaaatgttctttagcagctgtcattatcattttagagacagagtcttgctggcattatcttccccattttgctcatggagaaactgaaataagaaaattatagtctgactttgacaagcacagatttgctctgttaaccctgctatgggagctggtggagggaaggttggaggtgaggtgattggctgtggtctagaccagttttcaaactaacttcctcaaacagatcttaataggtggctagatgtgcctgaccttctttgactgcaatccaggctggagtgcagtggcgtgatcataactcactgcagcatccaactcctgggctcaagggatcctcccactactgcctcccaagtagctgggagtacaggcatgcaccactatacctgacttatcttttaaaacacttttttttttttttttttttttgtagagacagggtctcactttatttcctaggctggtcttgaactcttggccgcaagaaatcctcccacctaggcctcccaatgtgctgggattgcaggcatgagccaccgtgcctagccccatcagcagttatttaaaacatcattggtatttattatcattattaattatgtttgctatcatggatactaaatatctgcccatctagatctattaccctgatctaaaattctaagttctaacattaccaaaaagaacttgagaagaaatgcctttccatagccagaaaacttgaagctgaagggattttgatttgctcaaaggtattctgtgagtcctttttatctgtcttcatgatctggaccctatagctataagctttcatgtggggaatagtgcttcaaaatgaagtgaccatttacaatatgagtccccagtgcaatatccctccttgggtaatattaggtactatcttggctcatttcatcaatatcttttttgactagtcttttactgattgccccaagttgttaacttcagatgatacaattaaaacacaaagaaaactggttgcaaagaaaaactgcaaaattgttttaaatgtttttctttttttaattttaagagctttaggggtacaggtgttttttggttacatggttgaattgtatagtggtgaagtctgggattttaatgtacctgacacctgagtggtatacatggtacccaaaaggtagtttttcgttccttacctccctccgaacgtcctcctttatgagttttcaaagtccattataccactgtgtatgcctttgcatactcatagcttagctccacttatgagaacatgcagcatttgattttccatttgagtacatcacttaggaaaatggtccccagttccattcaagttgctacaaaggacatagcataaaaaacatcctttttggcgattgagtagtatcacatgatgtgtatgtacaccgcattttcttgatctacttgttgggctcttaagttgattccatatctttgcaattgtgaattgtattatcataaacacacatgtgcaggcaactttttgatataacggcttttgttttctttgggtagatactcagaagtgggattgctggatcaaatggtagttcctttagttctttaaaaaatctctatactgctttccatagaggttgtactagtttacattcccaccaacagtgtataagcattccctttttactacatctatctgggccaacatctatcatttcttgactttttaataatggccattttggctggggtaaggtggtatctcattgtggttttaatttacatttctctgatgattagtgatgttgaacatttttttcatgtatttttggccatttgtatattttcttttgagaaatgtctattcatatcacttgcccacttttaaatttaatcgtttttctttttttgctgatttatttgagttccttgtagattttggatatcagtcctttgtttgatgtaaagattttcccccagcccatagattttgtctgtttactctgatgattatttcttttgctgttcagaagctttttagtgcaattaagtcccatatatttatttatttaacattttgcttcatttgcttttggggtcctagtcataattttttttgcctaagccaatgtccagaagagtttttcccagattttggtctagaattttgatggtttcagttcttagatttaaatctttaatccagtcccctctcccctctcccctctcccctctcccctctccccacggtctccctctccctctctttccacagtctccctctgatgccgagccaaagctggactgtactgctgccatctgggctcattgcaacctccctgcctgattctcctgcctcagcctgccgagtgcctgcgattgcaggcacgtgccgccacgcctgactggttttcgtatttttttggtggagacggggtttcgctgtgttggccaggctggtctccagctcctaaccgctagtgatccgccagcctcggcctcccgaggtgccgggattgcagacggagtctcgttcactcagtgctcaatggtgcccaggctggagtgcagtggtgtgatctcggctcgctacaatcacctcccagccgcctgccttggcctcccaaagagccgagattgcagcctctgcccggcagtcaccccgtctgggaagtgaggagcgtctctgcccggccgcccatcgtctgggatgtggggagcgcctctgccccgccgccccgtctgggatgtgaggagcgcctctgcccggccgcgaccccgtctgggaggtgaggagcgtctctgcccggccgccccgtctgagaagtgaggagaccctctgcctggcatccgccccgtctgagaagtgaggagcccctccgtccggcagccaccccgtctgggaagtgaggagcgtctccgcccggcagccaccccgtccgggagggaggtgggggtcagcccccgccaggccagctgccccgtcagggagggaagtggggggggtcagccccccgcccggccagctgccccgtccgggaggtgaggggcgcctctgcccagccgcccctactgggaagtgaggagcccctctgcccggccatgaccccgtctgggaggtgtacccaacagctcattgagaacgggccatgatgacaatggcggttttgtggaatagaaaggcgggaaaggtggggaaaagattgagaaatcggatggttgccgtgtctgtgtagagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgacattccctccactattgtcctgtgaccctgccaaatctccctctgcgagaaacacccaagaatgatcaataaaaaaataaattaaaaaaaaatctttaatccatcttgagttcatttttttatatggtgagtgatagggatccagtttcattcttctagatgtggcttgccaattttttagcactgattattgagtagggtgtccttcccccagtttatgtttgtgtatgctttgtcaaagggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaggtcagttggttgtaagtatttggctttatcttggggttcttttttctgtatcactggtctatgtatacacttttataccagtaccttactgttttggttactattgccttgtagtataatttgaagtcaggcaatgcgatggctccagatttatttttcaagcttaggattgctttggctatttgggttcttttttggtttcatattaattttaggatgttttttctaagtctgtgaaaaatgatattggcattttaataggaactacactgaatctacagattgttttgggcagtgtggtaattttcacaatattgattcttccaatctatcagcaatgagatgtatttccatttgttcgtatcaactatgatttctttcagcagtgttttgtagttcttgtaaatatctttcaactccttgcttaaatatattcctaagtattatataatttttttggtagcaattgtaaaaggaattgagtccttgatttgattctcagcttgctcgttgttggtgcatagcagtgctactgatttgtgtacatttatcttgtaacctgagactttactgaattcattgatcaaatctaggagtcttttggatgtgtcattagggttttctatgtgaatgatcatatatcagtgaacagcgatggttacacttcctcttttccagtttgaatgccatttatttctgtctcttgcctgattgctccagccagaacttccagtagtatgttgaatagaagtggtgaaagctggcatcttcgtcttgttccagttcttagggggaatgctttcaacttttccccattcagtatgatattggctatgggtttgtcatatatgggtttgtcttattttgtggtatgttctttctatgcctagcttattgaggctttttatcataaagggatgttcattgtattgaattttttctgcgtctattgagatgatcatatggtttttgtttttaattctgtttatgtgatgaatcgcatttattgaattgcgtatattgaaccatccctccatccctgggatgaaacccacttaagcctggtgaattttttttatatgttgttagattcattttgctagcattttgttgaggatttttgtatctatgttcataaggaatattggcctgtgatttcctttttttgttatgtcctttcctggctttgatactggctttataggatgagtaaggatgattccttccttctgaatagtttgtaatagtttcaactattgagaaggagtaatattaataccagttcttctttgaatgtctggtagaatttgtgaatccatttggtcctggggctttttatttgttggcagattttaaaaattaccgattcaatctcagtgcttgtcattggtcttttcaggatttttatttcttcctgattcaagctaggggggttgtatgtttccagtaattcatccatttcctctagtttttccactttatttgtgtagaacttttcatagtagtcttgaaccatcttttgtatttccatggcgtcagatgtaatgccctattttcatttctaactgagcttatttgaatcttctctccttggttaatctagctagtgatctaccaattctgtttactttttcgaagaaccacctttttttttttttttctcttttagtcagagtctggctctgttgcccaggctggaatgcagtggcatgatctcagctcattgcaacctccggttcccaggttcaagccattctcgtgcctcagcctcctgagtagctgggattaccgatgtgtaccaccatgcctggctaatttttgaatttttagtatagacagggtttcaccatgttggccaggctggtttcgaactcctaacctcaagtgatccacccacctcagcctcctaaaatgctgggattataggcatgagccatcatgccctgcccaactttttgtttcactggtttttttttttttttttttttttttttttttttggttttcatttcattttgttctgttctgatttttgtatttcttttcttctgctagctttgggtttggtttgttcttggaaaactgcaaattttttaaaggaagcaagatttcatgaaggtgattaaagtgatattggggaactgttgaatcagtcattaatttaagaaatacttattgggtacctacttgggtgtccaaattgggtaccattttctaggtactaagtgttagagattaacgttgactattccagccttcatggacctgacatgccaaacttccataaaaccactggcaaatggatctggtgaagttgaaccagttaacaatcagaagagataatcaaaaatatgatgtgatagatgctttcagtggatttaaaacatttctgcaaattctttgacattcttcctacaaaaggtgaaacgtaatctttctctccttgaagatgggtggactttagaagtttgcttccaaagacgagagtttagcagaagtgatgctgtatgacttcacaagctaggtcataaaagtgaaatggcgtctgccttctctttcaggggcccacctgaagctgccatgctgggaagaccatgtggtgagatcagagagaaatggagaaagatgcttaaggagtgcttgttgttttgttccccagctgttggagtcttcccaggccagatgccagatgtatgagttaacaagccgacaggtgacaccgctcccagactgaccccatcagctgggacgagtggagaaagggtgagctattcccactgtgccctgctcaaactgcccatttttgagcaaaataggtgttattctaagccagtaagttttggggaaatttgtcacagagttattttccaataactggaaaaatgcctcaagtgagcatgataggaatatcaaaggattaatagagatccatgagaaaactgaagaaacctttgcatattttttgcagaaata

SEQ ID NO: 1742 - DNA, 40914 bp, Homo sapiens
ctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaacctccataaattatttattgtaagtatgtttgataaggattgtacagctgagagttcaaggttgcatttttttccccagcaagaaccaaaagtgcagataacatgcagccaattaaggacaaatctgtatggtttgtcaatcaatctgtcaggatgtccctgaattgtagcacttatcacttggtattatagacatctgtgtccctggcataactgcatcctcttcaagggcaggaattgcttcttttccatttttgcactctagcatccagcattatgtttgagacctagcatctatatgagagactttgttgaacggaatcaattgaaaggcttcccattatcatgcagtactacttgacaaagatcagaaccctgagcaatcaagggcaggaaacataggctagctgagctttgaaggaagtgaaaagaaaaagaggcagcaaagatgggaacatggaggacagtctgagaaaacaagctcagggttgaagggggtgttccagtgaaggggtgatgagtgggacctcacacatggagcagataacattggtgcatcagttgatttaaatgagcagaatggaaagtgtctaaaagagagatgtggaaatgagtagaaacatccctttcctgttgggccagctattgtctatggttagtccttttcccatccttatttcctctcctctgaattgcaagttgctggaaacatgagaagtgcattccttgctcccttggttactgggcttcagttagcatttgccaatgagggtgagcactcatgggagactggaaagtggtagaaagggaaagccattcagctggctgtgacagtggcagcagcgggcagtaccgtgggctccaacagcattggtggtggctccagcatcatcactgggagcttgggctcctgggttcctgctcagcagctatggtcagtaccttctgagatggcctcctctgatcctcacctcttggtattcatggccttgtgaaatcccctttgcttgagtaacttgctgccaaccaatagaatatggcaatgttgagggttgctacctttctgactaggttgcaaatgattgtgacttctgtcttgctggcaggctctctctatttgccttttggtttgtgtgctctgaggatgcaaactgccatgttcgtgagacctgcatggcgaggaattgagggcagactctgtccaacagccagtgagaaactgaggtccaacagcctacacggagctgaatcttaccaataactacatgaacttgaaagtgtatccttcccttcagatgagtgtagcctgagtgacaccttaactgaagcctatgagaggccctgaagcagaggaaggacccagctagctcacacctagatttctgatgcatagaaactgtgagatagcatgtgttattttaagccagttttgagatgatttgttatacaatagcaatagataacaaatatgatggcagagctctgttccaacagcagtagcaagcgtgtgcttgccgactctggatcactccacattcacctctttgcttctacagctatgggacaatagcagcagcgtcctacagttgccaatttctaggtaatgccattttccacttgacctgtgttttcaaaacctttgtcaccattttcctatattaaattccttcataataacagaagagtggctaacatatgcacacaactatttttcttgatagggagataaagagagcattgctgtatattaaatgtagttatgtctttttagatgtttaagaaaatgaaatgcaccttttttcaagtgaataaatgtttgcctctctgtagttcttggtttttgggagaaggtcaacttcaaaagatagagtcattggcaccttctttctgtagtgtgcttgactgtatatccctgcccacccacaggcagcaaaggcaatgcatgagggattttgaaggacacacagtagctgcttctgttttcatgtgggagtccaaggaagtataaatgctgcatgctccctgtaactagaataaaatattatggtgtgtgtataagggcaaactcctaactcagcaggtgaacaaccatatcgacttcattccccctggagactgaaattagaaagaaacctacatatcaggccacagcagcccttgatgaagctcaaaagagaggtggcaaactcacagctacacagcaaaaaccaagtcagaggcagcaaaagctgtagtttgagaacaaagggaaagaaaaagactagtcaaagaggccatatctacccacccacagaaaacccagagaagaaaataagttacatttctcccactggaaggcttgggggaggagacattcaggaaagccacaggggcagaaaattagatagtttatctgaaaaaggaaaaatgaactaaagtgtgcttttgatagatggctggaagtgagcacaaaggcaaaacaccaacatacacttggcgtctgaagaatgtcttttatccaaagatcttagagcagtttgagtgtattaatttacttgtgagacagttaaattattattcgttcatttttatgtggcattttattctaaaatttgctaaggattttataactcaagtacattggttattccccaaacagccctgtagatgcagtgtggccattactgtatgacacatgtggacactgagcctcagagatgtcaggaaacagagagaatcagaggaggctggaagatcagcgatgactgtatgaacactgaataaggaatggggaactctgtggagacaactcagtcttttctatggctatttcttcatggcttctgtggtagatagaatgatggtcctccaaagatgtccacatcctaactcgtggaacctgtggatatgttatctaatatggtggaaaggactttgcagatatataagttaagaatattgagaggggaaaattctcctgggttatctgggtgggcccaatgtaatcacaaagatgtaagggagagagggagacatgagagtcagagaaggagatgtgatgatgggcagggattgcaatgatgtggggccatgagccaaggaatgtgggaagggcaatggaacacgttcttcatctaaaactggaaagggtaaggttacatcttctcctctagagtttcttgacaacccatcttagacttctgacttatagctgcaagatcataagtttgtgatgttttaatccactaagtttgtggtaatttgttatagaagccacagaaaactcatacagcatctttgaggagtggggggctgcactgtaaacctaaaattttattttttgagttatttgggtaacacaattttagaggattttttttaagaactgtttggatatgtattaataacaattatgggtttagtggcttgaaggaaaaatacagtggcagtaacaacagcaatagtaatgggttatagttattaaggttgtgtgtgccaagtgctgggtaggggtgtggatgttccttctctctcattttctaaaacaattatatgggataattaccttcattttacagaggaggaaactgagtctgagagagccatgcaattagtggtggagctggcatttgcacacaagcatatctgactcttgactacgacctgaagtggtttttctatatacttaattcattgatgggaaaggacaagtcatgtgtgaaagcagggacatgagcaggtgatgacagaaagttgagacaggcctccggtggcactggggatgtgtattgactctgcctcagccatgacagaggtgagggacactgtctcctttccgtcttttctcttctacccatgccagccagccacttttataaagtacccaccatcggtgggcagcacttttccccattctttcttgccaagtgtgactcttctcttgaaagaaagcacacaatttcacactgtataatgagtgtctttcctgccagaaacaacaaggatggagaggctgtggggctactttagctgccataagttagaagggggtcaagtgagtgggatcaggaggatgtaagatgagaagaccaaaattttaatgagatgctgctggaatcagcataaccaagtatggtatcagagctgaaataacttaaaatattacaagtgccattgtaaaatgcaatactccctacttcctagggtggctgtgagaatggagttaataaatgcagagtgctttggatggtgctatagaagtgtagctgttactccactgcacccatcccgcaactactcctgctgctaccagcgccctgttattatcgccactgccaggattactaccactatcacaattactcttactactgccattgactacctttgctaccatcacattatttcaactgctaccattgctgctgctattactactactgtaccgttgctatgacaattattaccattactactgttactgtcaatctgtaggcatagaaagtgcttctgttgtaataaataggccaacagacttctgtaccttcaacaagggtggctagagcacatcctcaggtcatcctgggattgcctggcaatagttcccagtctgattcttttctttgggctgttggcattcttttgctactgctcaggtttggacaaagtggctgtcattgccccaagctctctgaggtaggaactctgcctgcttcactaattcttctcagtgacaaatgctcctcaaatctattccccagtggccatttgaagtggacaaacaactccacagccatgaaatatcatgttttaaatagaaggcactgtgtcaaatgccaccagcaactcagccttggagctgctgatctcagactgattcagattcttggagataatcataagaactaacctttaacaagtgcttattgtgtcttatcaggtgctgttctaggcacttaacaaagatttaattatttgactctccaaaaaagtcttcgaaatagttactgctatgaattatgttttacaaatgagaaaactgagacacagagaagttaagacatttgctcaagataatacagcaaatgggaaagctgggatttgaacacattcagtctaactccagagatgctgctgctggccaatgtaaaccaacacattggcttcacagtacacagcattttagtcagagaagatcaaggcctagcaaagacagctgcccatagttggtgctcaataaatgctagactagtgaaggaatgaatcaacaatgaatggaagaatgagagtaacatggtgtttgtgtgagtgaagaaagaaggcagtatgagtattctaaaccaaacagtcaactcagttattgtcaagaacagattgaaaaggaagtcaaggtagtcaagaaggaattgataaggaattatgcatagagacctggtttgctggaggatctagggaattgtctctaaggattttccagggcctggggaagacagttcagtggagggaggtgggaggacttctagaacacttggccttttcttagaccaggggtccctgaacccctgggccatggactggtactggtcagtggcttgttaggaactgggcaggacagcaggaggtgaatggaaggtgagcgagagaagctacgtccatgtttacagccacttgccatcacttgcattactgcctgagcgccacctcctgtcagatcagcggtagcattagattctcataggaacatgaaccctattgtgaactaggttgtgtgctcctcatgagaatctaatgcctgatgatctgaggtggggctgaggtgatgatgctagcgctggggagtggctgcaaatacagataaacattagcagagagggttgactgcccacaataaatcagttgcttgcagactcatatcaaaaccctatcaatgtgtggcaaatgaccagccgcatctggtggcaggctttatagtggcaagtgagttgaaaaaaagtgcacaataaatgtaatgtgcttgagtcatctcaaacccaccataccccttacctctttcctgtggaaaaattgtcttccatgaaactggcccctggtgccaaaaagttggtgactgctgccttagacctttctggtgtacctcatgatatagttccagtctctacaaccagtcagcacctttctctgatgcagagtgatttgtttgcttcttttagttattaaaaattgtgtgtcataggattttagtgctagaaatctctctagaggtcaagccccctcatttcactgattaggatactgagtcccaaaggggttacgggtcttgacaaggccacaacaatagggatttgctaggccccaacatgcacctttaattctgattcattcatttgttcaccccaatctggtgacagtctcttgtgttgtcttgaatgtcttggtatttcagataaaaagcctggcttaagtttttgatcatagccattctaacaggcatgtcatgaaaaaagacaagagatgaatgtggacgaggtcgtagagaaagggagcccctacacactgttggtggggatgtaaaaggtgcggccgctataggaaacagtatggagtttcctcaaaaaattaaaaatagaactgccgtatgatccagcaattcctctgctgggtctatacctgaaggaaatgacatcagtatgttgaagaggtatccgcactccagtgttcactgcagcatgattcacaatagccaagatatgcgatcaccctaaatgtccatcagtggatgaatggataaagaaaatgtgatattgtacaaactggaatactattaagccttaaaaagaagaaagttctgtcatttgcaacaacacgaatgaatctggaggatattacgctacatgaaataagccaggcatagaaagacaaacactgcatgatctcactcatatgtgacatctcaaaaaatcgacctcacagaagcagggaatagaatggtcattgccaggggctgaggggctggggtggaaataggaagatgtcagtcaaaaagtgcgaaggttcagcagctagaaaatgaatcatttctggagactagtgtacaacatggtgactaccgttaatatgcattgcatacttgaaaattgctaagggagtagatcttaaacattctcactacaaaaaataataagtatgtgaggtgatgaatatgctaattagcttgattgtggtacaatgtatacatatatcaaaacatggtgttgtgtgccttgaatacatacaatttttatttgtcaattatactttaatgaggtagggaaagaaaaaaaagaagggagagaaagagagaaatctaaaattaaaaaaaaatggaaaaaaggtcggcttgggccagggccataggcaaactttgtttttcataacactggatatgacaatgatctaattagctaattaatttgcactgtattcttttgctacaacgtcatataactttcgtctttaagatggacaaactaaggtaacttgcattttccttcatttaatatttaaaacctctttataagaaaaagcagccccaaagaattgtttgtactcatattaatatcacttaattaaaaacatttttcagcattgtaacaaatagaacaaccttagctgtaatatatgttcttcttgcagcaaagttttgcctctttacaccatcaataaatgtgagcattataagattataataaattatttagattatacttacttttaatcattattttctcagtaaattctaaaattcaatgcaaaaggaactaagatgacttagttacatatgtttcacactggactcattatagctttctgggagtgactatgttactttattaaaaatttcttttacctttaataagggagaaagacagagaccattatgtcatctagtttctcattctgtcctgcttagcatataacttcttcattattgtactctccatagttcctcctgaatagaaagtatcaaatctcctcttcacgtcttcactgtaattatcattcttatctgacataaaacagtgattaaagtaacccatctctagaactaatttgatatataacaataaaaacttcttgacaaatttcaatgtcatctgggtggtttagatatgtacacactctgttattgattttccctcctttgataatacagcactacttatttttaggttttctctaactcaaaaggaaaaaaatgctgtttttattcttactctcactaaacgcttttatttaaagtgtaagtgaccatttggtagaagtcacatagattgtgcaatattttaatccaagtgagcaatctggttctaataccttttgcttgtgggtggggacacccatttttgctacttcaatggcctacaattcaacctgatcccaagacttttgctattcatctctcctcccgcatttagctgttccgttattccattgttatattattgtgggatttatatgaattagcacagaaaatggaactcaagtgttcagatttaagcctctttctttctttgtagagcccaaggcagagaaaaatgtagatccaggaatctttttcttttctttgtgacattactaaggagatgctatttttccattttataagtggaaatattaaggcagagccaacttcggggacttgcttcaggttatatagtcaatctgggttgtagtcaagaggaacaaaacataaaaataaaagttggtgaaataaagaaactgatggccccaaacagtattagctgaaattgctagtataaaagaactcaaggaaagtttaagtaaaattgtggttgattgcactttaataggaacttaaggacatttaggagttgtttctaagcttgtgaggccttgattatgaaggaagttgcaactatttcctacaaaatgcctcttggtactattgtcagacagttggtctaagccagtgtggcaattcttactttattatgtttccccaagccccttttggtgttttatctagtggagcattcatctgagacaaacagcttatgtactctttctcgccaagcagaagctagaatgaatgagaaaatcgcataagaaaatctgtcctcctgatttcccacatgaaactggcttggagagtcactgttcccttgacaggagccttctgcaggctccaccaatacttgtcaaccgcctggcttgttgtgggggtggcggcagctgctacttctgcttcttcaaaataaaaaccgcaaataagtatatttagaaagtgtgtccatcctagttcatcttcccagctgttttcctggtggaattagattagcagtgtaagtgaaatcttttctgaacctcatcgaaatccagacttgcctagtaaatggcttcattcattattttcatttacctacattctaatttagtttttcttatttttatgaacagttactatataccaagtactgtgcaaaaggctttacagacaatatctcatttaatctcaaaacagccttacaaagtgggtgttaccacccgtatatggcaacaccaggtttaagtgactcacctaggtcactcagcagggtgtcataatctagtctggctgattccagggcctatgttccaggatacgccatggccccagctgaggactttattaaatagtctatggtcttgcagagtcaaacctattctctggttcttaaagatggaccacttgaaggcaggtccttgaagagccatgggcactgacagtttttgctcactagggattggtggtaatgtctcaggttttctgtgagttcaattttcatgagcccagtttcgcttcagtaagtattgatctggccctagaactcatggtttgtgtgtgtgtgcgtgtgtgtgagtgtgtgtgcgtgtgtgtatgcacacctgtgttctctggcttggagagttagcaattactgatgatcagggtttccttaatctctcttaggaagacttcttagtctttatttatttggaggtcaaattgtgtacagtatttctcccagagattccttcttaattcaacaaagggaatgttttagaagaaaacaaagggaaaaacaatcaacaccaatccccaaacacccatatacatgcacatgaagaaaatgtgcaacatagctagagatgcattatcagagcacagattaattatttgaagcaaggtagactattagtttctgttagccttgctgggacttatttctgagcttctaattctagatatgagccccatgattacctcctttggccctgcttaggccctcttccatctctacagtcactctggttcctgggcaagtcttccttaatgcgcaaggcatttctcactgtggttccatgactcctgtctggaatacgggctatctggtctacttgcagtctgagtgacgcttaacttctttactcattggcataaggagtggctgagtttgctttctcttgaggttctggagtcccaatagttgaagaattcatcctcggagactcttcgctccagtccagcttcctgccatgcagcaaaagcctgcatttcttctagtttcaagcctttgcatcacctgttagatttcttactatgttcctccttcagccttaaaaggtatctcttgtgctcatttgtaggactggagttctaaaagaattctgccctggtaccaatcattccacctccctagttactctatgggacttactccagttgaaaccagtagaaaaatacctcacacatacagtggcaatagtaaacatacaagagaaagaatattcattttctatatgcctttctcctattttataagatataaaataagaaccttgaatgacaatgagcttttgggggaacatactttattcccacaggatgttccctgttctgggcctctcacattcatggacatctcatacatatgggcatcaggtacgatactttcagttgcaagtaacagagatcaactctgactctgaagctggtatagtggaggctgggagatcatgtctagaaaatgaacatgaaccagagagtcaagaaacacaagaatctggccacaccactgctgtggtcatgctgatgccatgaatgcatttaaacaagactttgtctttgcttcaccttctgcaaagtcagatgagtgagaacatctgataggcagggcttgatatgtgtcagccttgcctatcaggtcatgaagacaggacggatcacgactctttggcttcctctgtgggaacctgtgggaagcctgtatgcccaggggggtttgtgttcctcaaaaccaggctggatgtggtggctcacatctgtaatcccagcactttgggaagctgaggtggaactcctggctcacttgagtccaggagctcaagaccagcctgtgcaacatagtgagaccctgtcttaaaaaaaaaaaaaaattagttaggtgtattagtgcttgcctgtggtcccggatacttgggaaagtggaaagattgcttgagcctgggagtttgaggccacagtaagctgtgcttgtgccactgccctttagcctgggctacagagctagaccctatttcaaaacaaacaaacaaacaaacaaacaaacaagaaagggggcaggttgactgctagactgccatagaaaaatccaatggccagttcaatgaattttcctcagtatttaaaaaaaaaatctcaattagtttttcttaacactattctcaatctagccctccctttcgttcttttcaaaatatataccttttaggttagcagttgccttaatactgttaacattttataccgagaccacagagttgctgctaaagtgtatagtcagaattgaattcagaagattgatgttctcttcaggctgcagaccatctgattactggatctcctctgggcaatgaagctgcctcctttttctcctctctcgaccgtcaagcttgcaccacagtaataatatttaataagagcagcagtgaaactatgtcattgcttctctgatggtcagagtggaacacagctccaaataaaacaggagtgattgtcatacagataatacagttgttttagttctttcaccttgagaaaggatgaggtagcttgaatgctgattgatgcttgtctctcatagtctactggaatatacattaggtatttgggtgaaactgtgagttgcacttgatcatgtattaaacattttgcaagctatttgctgctgtatattctgactggatcttgaaaaacacccttgctatttcaggataaaagaaataaagcttttgtggttttggctgctctacctaagtcaggagactctttttctgagaatatttaaacattttgccacattcatctgtctttttctcacactatcccagaataactgaagatatgtaatacagggaaaccttattaaaaaaaaaacttctacctaaagaaatctgaatttatataacagaaaaattgtggagagattatttatattaaaaaagattttcttttttttttcacaaaagtgttcacgttaggctttctttaaatagcaaagtcccttactggattaaaatatgactgaatttctctttcagaaatgcatctactgtttaaaacaagccatgttttatgtcatccaattttataactgaagaactgagaataattcagaaaaaagtcacagaaactttgtgtggatctaggaagataattcagggctaacgatcactcctatactctcctagaaagagagtagcttccatggaaatgaactgagacccttccttcctagaacctggaagattcctgcattaagtcacgtcatagtcataaggtcattcaactattgatgacattttctaactacgtgtggataagcttttatgttgatggttcagattttctgctttggaaaaaaggaattttagtgtatttgacttctaacaataaaatatatgcaaagaaaagtctgtcattagattccctagtttgtaatttaggggaagatatttcacttcaacctttctgggccttagtttcttcacttataaaatgaaggttttgaactagataatctctgagtccttttatagctcccaaacttgcttcttagttgtttcttttatttttaaataagagtaacacaaatcctgtaattctgagagtctagatcacagactgatctcatctatgctttatcttttcattttataaatgctcttggtgtttgtaaagcttatgtccagacttgaagccagttagaggcctaaagaacagtgcaaaagaatgttagatatacctggatactcttcctcttctttttaaaaaaatttaatgaggaacaaaatcttagattgttacacagcagaggtgcaataaagaataaaaatgcaagggaggaaaagtcacaaagccaatgaacaaaaattcccctgtggtgagggtcttaaagcaggtgtagtggtttatcattttactgaatgagctctgggtctggtgggttaaaacaagatcctctggttaagtgggacaatgaaacatagatggggaagcaatagccctgctaaagactgaatatttatatcccctcaagttcatatgttaaaatctaatctccaatgtggtggtatttggaggtagggcctttgggagtgattaggtcatgaggatggagccctcatgaatgagattagtgccctaccaaccagggagctcacctaaacatctgtgtccagagcttttattggggcttcattatataggcatgattgattgaagtattggccaaaatattgaatacaatctccagccctcctccttataggtcaggctaatatcacatggctcaaagcctcaattctctaatcacatgattggtctttctggcatgaccagcctccatcctgagtaatctctttggcttaagctattataggcgtcagaagtcacctcattagcataaaccttcagggcccaccatgaataacaaagacactcatgtcactctggaaattctaaggatttagaggattccttctaggaaccagggaatagaaccaaccaaactctttattatgtaacatattgcttttggcttttgtctgttctgtagcttttgtaaggaatatgactagcaagttgttaaatctctctctttctctgacgagacttcaagactgaattgaagtcattaattggtttagagtcagagtagcagaatggttaacagtgtgggtttggagatcaggctgcttgggttaatcttggtttcacatcttactagcttggtggtcctggacaagtttcttaacctctctaagcctcagtttcctcttcagtaaaatgataggttatcatgatgaattaagctaatgtctgtaatgtgcttagcatggtgctgggcacacagaagcagtcaaggtttgctactaacgattgcgttaggattttagaaaagctgttgactatttctaaatgtttactttctaaaggtggcatgccctaaatatattcaggccagtggttgtatcagatttttagtttttaggcactgattctttgttaaaggaaatctttcacaaaatccgaatctagaaagccgatgaaatctatattaagctgaactcctctagtcaaagagggtcaggcacatctagccaccttttaatctctggggaattaagatctgtttgaggaagttagtttgaaaactggtctagaccacaaccagtcacctcaccttcaacctcccctccaccagctcccatagcagggttaacagagcaaatctgtgtgtgtcaaagtcaggctataattttcttatttcagtttctccatgagcaaaatggggaagataatgccagctttgttgtggcagtgaattagataatgtctgtaaactattttgagtctttagagatcagttttagggacaaagacctttgccatctttaatttttagcttactttaaaaataagatatcctaaacacaccacttaaaaatgggtcaaacagtcgttttgtctattcttgggataaggtggaagcaatgatttaatcaccacagaagaaatgtgctctgattaattgggaagaaagattttaaaattagagttattcagaaagcctgtcaggagaccaggaagagaggaaaggatgtgtgtcaacacctacagaaagctgtctgtgaagctgggttataacctgatacttctggtcttccctgtaactaaatgtcctttgctgaggcctgaggcagacccttactctgggtttcctgttcctgtatgactagtttcagtcaggctttacgtagtcattctgccctgcagagcaatcacaggaggtaagaaggcatggtcgttaatagcatgggctatgctgttggacttgaatttggtcttgtttctatcacattctgtaatttagttgaaaaatggaaataacacctatctcaagggtttgttgcaaagactacatgagattatacatgcacagcgcttagtacagtgtctgatacatagtaaatgttcttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccacctcagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgagtaaatgttctttagcagctgtcattatcattttagagacagagtcttgctggcattatcttccccattttgctcatggagaaactgaaataagaaaattatagtctgactttgacaagcacagatttgctctgttaaccctgctatgggagctggtggagggaaggttggaggtgaggtgattggctgtggtctagaccagttttcaaactaacttcctcaaacagatcttaataggtggctagatgtgcctgaccttctttgactgcaatccaggctggagtgcagtggcgtgatcataactcactgcagcatccaactcctgggctcaagggatcctcccactactgcctcccaagtagctgggagtacaggcatgcaccactatacctgacttatcttttaaaacacttttttttttttttttttttttgtagagacagggtctcactttatttcctaggctggtcttgaactcttggccgcaagaaatcctcccacctaggcctcccaatgtgctgggattgcaggcatgagccaccgtgcctagccccatcagcagttatttaaaacatcattggtatttattatcattattaattatgtttgctatcatggatactaaatatctgcccatctagatctattaccctgatctaaaattctaagttctaacattaccaaaaagaacttgagaagaaatgcctttccatagccagaaaacttgaagctgaagggattttgatttgctcaaaggtattctgtgagtcctttttatctgtcttcatgatctggaccctatagctataagctttcatgtggggaatagtgcttcaaaatgaagtgaccatttacaatatgagtccccagtgcaatatccctccttgggtaatattaggtactatcttggctcatttcatcaatatcttttttgactagtcttttactgatt

SEQ ID NO: 1743 - DNA, 21529 bp, Homo sapiens
gcctaagatcaaccacaaagtgacaaaatcaaatcacgatataaattaaatgatcccattatcataaaaatggatataagtacatacacatacatagaaatagcaaaggtatacccataacaaaagtcaaggatacagtaattgtctctgaaatgtggggcaaaacagggaaaagagggtctttcacattttttgttttttattttagataagaggctcactctgtcacccagtgaaacacatgttgcccaggctggcctcaaactcctggcctcaagtgatcctcctacctcggccttcccaagtattgagattataagcgtgagccccctgcacccagccccttttactttttaagttatgccctcctgtgctctttatttttaccagaatgtattacattcataactttttatgtgacatcttctaatcttccacatactgtaaaaggcttaacacacataatgagtactcagttttgttttggagacagggtttcagctctgtcacccaggctggagtgcaacagcacaatcttgactcaatgcaacctccacctcctgggctcaagggatcctcccacctcagcctctgagtaggtaggactacaggttcgcaccaccaagcccagctaatttttgtgggatttttttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgagaaaagatattggcgggggaggaaatgaaggagaaatctcaaacatttaaaatataacttccaatataaaattaaaaggtccaagaataaataaagtagaagagatggccagaccaaaaaaaaacaaacaaacaaacagacaaaaatattggggaggattaattcagtaagtctaataatccaactaaaagcagctatagagaaaacaaagaaaagatcactagaggccgggcgtgggggttcacgcctgtaatcccagcactttgggaggccgagatgggcggatcacgaggtcaggagatcaaaaccatcctggctaacaaacacggtgaaaccccctctctactaaaaatacaaaaacttagccaggtgtggtagcaggtgcctgtagtcccagttacctgggaggctgaagaagaatagcttgaacccaggaggcagaggttgcaatgtgccaagatggtaccactgcactccagcctgggcaacagagcaagactccgtctcaaaaaaataaaaaaaagaaagatcactaaagccgtaacatgaaaactttcaagaagtgaagcacataaagtattttgcttattgtaatggagaagaaaacacatctggacatctttgagaaatttcagtttaatgaggataaaagaaggctctaaagggatggatgaaaatatgaaacacatcacccacaaaggaagaagaatcacacagtatccgacttttcctcaccaacaacaatggacatagaagacactggagcaatcccttcaaaactctgagggaaaacaattttcagcttaattgcacttgaataaaataataccagtcaactgtaagggctaatgaggacttttacagataagcaaggattcaaaactttatttctcacatattctttcttagctatttatgtgggtgtactgcattaaaacaagttagtaactcaagaaatgataaagctctaataacagtagtagcactgtgcaaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatggcatccggccttcaatattttctggatgaaagagaggacttattactagtcctagattattatgaaaaacagcaatatcatgattaaaattttgttcctcctcccagtactgtgttctattaattagataggaaataggaatgaacaaaaatagacattaaatcaaatgattttactttctaaaagtcaaaaattctaatgctttgtttacctatctacaaatatttatcttactacttctataaataattgaataaaatcttaaatgaactaaaagaaataatgggacttttcactacacaaaagataattacctatacaatgaaatgaggtgaaattcttagagcaaatatgtcatacaacaagcttaaattaatgatacgaaacagttagaatgcccccaccccaataaaccatggacaaaacacgactgggcaattcgcaagaaatacaagtaataaaattcaaaaaaaggctgacgcggtggctcatgcctgtaatcccaacgctttgggaggccgaggcgggtggatcatgagatcaggtgctcgagaccagcctggccaacatagtgaaaacccatttctactaaaaatacaaaaaaatagctgggcgtggtggtggatgcctgtaatcccagctacttgggaggctgaggcaggagaactgcttgaacctgggacgcgaaggttgcagtaagccaagatcgtgccacggcactccagcctgggcaacagtgtaagactcaggtctcaaagaaaaaagaaaaagaaattcaaaatattcattagtcctactaatcaagtaagtaaaagcttagaactactttttttctgttgttaagataaagattttaatatatcatacatgacaaaggtttgataaaactagacctatcacacattgctaatgacattacaaattgatgcaacctttttagggagtggcatttcaaaactttaataaaaataagagatcagggctgggcatggtggcttatgcctgtaatccaagcattctgggaggccaaggcaggggagatcacttgaggtcaggagttcaagaccagcctggccaacatggcgaaaccctgtatttttagtattctactaaaaatacaaaaattagtcaggcgtaggccaggcgcgatggctcacacctgtaatcccagcactttgggaggccgaggcgggcagatcacgaggttaggagatcgagaccatcctagctaacacggtgaaaccccatctctattaaaactacaaaaaattagccgggcatggtggcaggcacctgtagtcccagctactcgggagggaggctgaggcaggagaatggcgtgaacccaggaggcggagtttgcagtgagccgagatcacgccattacactccagcctgggcgacagagcaagactcatctcaaaaaaaaacaaacaacaacaacaaaaaattagccaggcatggtagcgcgcctgtaatcccagctacttgggaggctaagacaggagaaccgcttgatctcaggaggcggaggttgcagtaagcggagatcatgccactgcactccagcctgggtgacagaacaagactctgtatcaaaaaaaaaaaaaaaattcaatgtaatttaaaaaaataagagatcaagccgggcacggtggctcacacctgtaatcccaggactttgggaggctaaagcaggcaggtcacttgagacaggagttcaagactagcctggccaacatggtaaaccttgtctctactaaaatcaaaaaattagccaggcatggtggcacacgcctgtaatcccagctattcagggcgctgacacatgagaatcccttgaacctgggaggcagaggttgtggagagccgagatggcaccactgcactctagcctgggtgacacagtgagacatcatctcaaaaaaaaaaaaaaaaaaaagagtttatatttatctcaaaaaaagagtttatatttattgcttgctaaggcatcaaatataagaaggaaaaaattttaaaaagttcgtatttactaagaacttactaagtaataggcacagctcactgcaaccacttcctcccaggttcaagcgactctcctgccacagcctcccaagtagctgggattacaggtgcccaccaccatgtctggctaatttttgtatttttactagagatgggtttcaccatgttggtcaggctggtctcgaactcctgacctcaggtgatccatccacctcggcctcccaaagtgctagaattacaggcatgagccactgcacctggcctctagcggctttcttaacacatataccctctttaaatcttttaataatcctgtgacaaagatgttattatcatccctattttataggtaacaaacagatacagattgaacagcttatacaaagtccaacaactagaaagtgataagaccagaatttgacaataagcaaatagacattagagcctatatgcttctgaatatctatgaagaatcaaaaaatgcttttttgttgttgttgttgttgagacggagtcttgctctgtcgcccaggctggagtgtagtggcatgatctcggctcactgcaagctccgcctcctgggttcacgccatcctcctgcttcaacctcctgagtagctgggactagaggcgcctgccaccacacccagctaattttttgtatcttttagtagagacggggtttcaccacgttagccaggatggtctcaatctcttcacctcgtcatccacccacctcggcctcccaaagtgctgggattacaggcatgagccaccgcgcccaccctctttcttttaaaaaaaaaaaaaaaaaaaaagatggagtctcactctgtcacctaggctggagtgaagtggcacaatctcggctcactgcaacctttgcctcgatactccttccttagcttcccaagtagctgggactacaggtgtgcgccaccacgcccagctaatttttgtatcttagtagagatggggattcaccatgttggccaggctggtgtcaaactcctgacctcagatgatccacccacctcagcctcccaaagtgctgggattacaggcgtgagccaccatgcccggccaaatgcttattttttaacctaattatcctgcctatggtaatctgtcctataaaaataaccaaaatatgaaaaaggctttatctacaaaaaggtcagccagagcattacacatagtaacaaaaggcagtagggtgagaagaggaaaaggggagacagctgtatggttacataaattatagtgtggttactcagttttttgttgttgttttgagacagagtctcgctctgtcgcccaggctggagtgcaatggtgtggtcttggctcactgcaacctccacctcccggattccagcgattctcctgcctcagcctcctgagcagctgaagactacaggcgcatgccaccacacctggctaatttttgtatttttagtacagagggggtttcactatgttggccaggctggtctcgaactcctgaccttgtgatatgcctgcctcagcctcccaaagggctgggattacagtcgtgagcgacagcactcagccctcagttttactcaatggaaaattaagcacccttcaaaaatgttataaaagattaacaatacggaaattttcttttacatgttacaagggaaagtaggttacaaaactctaaatgtacataagtagtatcacaaaaaaaaaaaaactgtgtatatgaaaaaagtttgaaagagaataggtcaggctgggtgtggtagctgatgtctataatttcggcactttgaaaggccaaggtgggaggatcacttgagcctaggagtttgagaccagcctgggtgacatagtgagacgactgtccctacataaaaagatttgtttttcatttaaaagaaaaaaaatagactgggcatggtggctcatgtctgtaatcccagcattttgggaggccaaggcaggtggatcacaaggtcaggagtttgagaccagcctggccaacatggtggaagcccatctctactaaaaatacaaaaaattagccgggcatggtggcagacgcctgtaatcccagctactcaggaggctgaggcaggagaatcacttgaactcgggaggcggagattgcagtgagccgagatcatgccactgggctccagcctgggcaacagagcgagactctgtctccaaaaaaaaaagtgggggaaagaaaacatttacatttataacaacatcaaaaacaatgaaatacttaggaatcaatttaacaaaaaaagtacaagacctgtgcattgaaaattataaaatactacaaacaaattaaaggagatcagaaattatacttcatttgatacttaatcacatgcaaaaaatcattagttccagttttacagttgttgccggttatttttctaacacagatacaatgtcatacctctgtttaacatcttcaatggctccctattgtttacagttaatattcaaaatgcccaatttactttcccttcctcatttcctcccatattggactgtagtctcttaaaaagcaaaggtcagggtcagacacacctggattcaaatcctgactcaatcacttacaagctatataaaaattcatctttcatttgtaaaacgtactaatgattcaaccccatgtgatcagtaattatcaaaaaggtaacttctggtaagcactagtagtgcctaacacataatagccaggta

SEQ ID NO: 1744 - DNA, 16769 bp, Homo sapiens
gcctaagatcaaccacaaagtgacaaaatcaaatcacgatataaattaaatgatcccattatcataaaaatggatataagtacatacacatacatagaaatagcaaaggtatacccataacaaaagtcaaggatacagtaattgtctctgaaatgtggggcaaaacagggaaaagagggtctttcacattttttgttttttattttagataagaggctcactctgtcacccagtgaaacacatgttgcccaggctggcctcaaactcctggcctcaagtgatcctcctacctcggccttcccaagtattgagattataagcgtgagccccctgcacccagccccttttactttttaagttatgccctcctgtgctctttatttttaccagaatgtattacattcataactttttatgtgacatcttctaatcttccacatactgtaaaaggcttaacacacataatgagtactcagttttgttttggagacagggtttcagctctgtcacccaggctggagtgcaacagcacaatcttgactcaatgcaacctccacctcctgggctcaagggatcctcccacctcagcctctgagtaggtaggactacaggttcgcaccaccaagcccagctaatttttgtgggatttttttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgagaaaagatattggcgggggaggaaatgaaggagaaatctcaaacatttaaaatataacttccaatataaaattaaaaggtccaagaataaataaagtagaagagatggccagaccaaaaaaaaacaaacaaacaaacagacaaaaatattggggaggattaattcagtaagtctaataatccaactaaaagcagctatagagaaaacaaagaaaagatcactagaggccgggcgtgggggttcacgcctgtaatcccagcactttgggaggccgagatgggcggatcacgaggtcaggagatcaaaaccatcctggctaacaaacacggtgaaaccccctctctactaaaaatacaaaaacttagccaggtgtggtagcaggtgcctgtagtcccagttacctgggaggctgaagaagaatagcttgaacccaggaggcagaggttgcaatgtgccaagatggtaccactgcactccagcctgggcaacagagcaagactccgtctcaaaaaaataaaaaaaagaaagatcactaaagccgtaacatgaaaactttcaagaagtgaagcacataaagtattttgcttattgtaatggagaagaaaacacatctggacatctttgagaaatttcagtttaatgaggataaaagaaggctctaaagggatggatgaaaatatgaaacacatcacccacaaaggaagaagaatcacacagtatccgacttttcctcaccaacaacaatggacatagaagacactggagcaatcccttcaaaactctgagggaaaacaattttcagcttaattgcacttgaataaaataataccagtcaactgtaagggctaatgaggacttttacagataagcaaggattcaaaactttatttctcacatattctttcttagctatttatgtgggtgtactgcattaaaacaagttagtaactcaagaaatgataaagctctaataacagtagtagcactgtgcaaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatgg

SEQ ID NO: 1745 - DNA, 14335 bp, Homo sapiens
aaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatgg
